United States Patent 11,241,493 (CORONAVIRUS VACCINE) - sequence listing, part 11

SEQ ID NO: 23172 - RNA, 3822 nt, Artificial Sequence
  SARS-CoV-2/Wuhan/WIV05/2019__EPI_ISL_402128 spike protein CDS gc mod (1-1273)(K986P_V987P_N501Y_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23173 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23174 - RNA, 3822 nt, Artificial Sequence
  SARS-CoV-2/Wuhan/WIV05/2019__EPI_ISL_402128 spike protein CDS gc mod (1-1273)(K986P_V987P_Y453F_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23175 - RNA, 3822 nt, Artificial Sequence
  SARS-CoV-2/Wuhan/WIV05/2019__EPI_ISL_402128 spike protein CDS gc mod (1-1273)(K986P_V987P_D614G_I692V)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23176 - RNA, 3822 nt, Artificial Sequence
  SARS-CoV-2/Wuhan/WIV05/2019__EPI_ISL_402128 spike protein CDS gc mod (1-1273)(K986P_V987P_D614G_M1229I)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23177 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_A222V_Y453F_S477N_D614G_I692V)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23178 - RNA, 3816 nt, Artificial Sequence
  SARS-CoV-2/Wuhan/WIV05/2019__EPI_ISL_402128 spike protein CDS gc mod (1-1273)(K986P_V987P_H69del_V70del_Y453F_D614G_I692V_M1229I)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23179 - RNA, 3813 nt, Artificial Sequence
  SARS-CoV-2/Wuhan/WIV05/2019__EPI_ISL_402128 spike protein CDS gc mod (1-1273)(K986P_V987P_K986P_V987P_H69del_V70del_Y144del_N501Y_A570 D_D614G_P681H_T716I_S982A_D1118H)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23180 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_K417N_E484K_N501Y_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23181 - RNA, 3813 nt, Artificial Sequence
  SARS-CoV-2/Wuhan/WIV05/2019__EPI_ISL_402128 spike protein CDS gc mod (1-1273)(K986P_V987P_K986P_V987P_L18F_D80A_D215G_L242del_A243del_ L244del_R246I_K417N_E484K_N501Y_D614G_A701V)
auguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23182 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_E484K_D614G)
auguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23183 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_L18F_T20N_P26S_D138Y_R190S_K417T _E484K_N501Y_D614G_H655Y_T1027I)
auguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23184 - RNA, 3822 nt, Artificial Sequence
  SARS-CoV-2/Wuhan/WIV05/2019__EPI_ISL_402128 spike protein CDS gc mod (1-1273)(K986P_V987P_K986P_V987P_S13I_W152C_L452R_D614G)
auguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacauga

SEQ ID NO: 23185 - RNA, 1369 nt, Artificial Sequence; identical to SEQ ID NO: 22814
  SARS-CoV-2/Wuhan/WIV05/2019__EPI_ISL_402128 spike protein mRNA gc (1-15,334-528) Ferritin construct R10337

SEQ ID NO: 23186 - RNA, 967 nt, Artificial Sequence; identical to SEQ ID NO: 22815
  SARS-CoV-2/Wuhan/WIV05/2019__EPI_ISL_402128 spike protein mRNA gc (334-528) Foldon construct R9926

SEQ ID NO: 23187 - RNA, 1345 nt, Artificial Sequence; identical to SEQ ID NO: 22816
  SARS-CoV-2/Wuhan/WIV05/2019__EPI_ISL_402128 spike protein mRNA gc (1-15,334-528) LumSynth construct R10335

SEQ ID NO: 23188 - RNA, 1306 nt, Artificial Sequence; identical to SEQ ID NO: 22817
  SARS-CoV-2/Wuhan/WIV05/2019__EPI_ISL_402128 spike protein mRNA gc (334-528) LumSynth construct R10336

SEQ ID NO: 23189 - RNA, 4039 nt, Artificial Sequence; identical to SEQ ID NO: 162
  SARS-CoV-2/Wuhan/WIV05/2019__EPI_ISL_402128 spike protein mRNA gc (1-1273) R9514

SEQ ID NO: 23190 - RNA, 4039 nt, Artificial Sequence; identical to SEQ ID NO: 22818
  SARS-CoV-2/Wuhan/WIV05/2019__EPI_ISL_402128 spike protein mRNA gc (1-1273)(D614G)

SEQ ID NO: 23191 - RNA, 4039 nt, Artificial Sequence; identical to SEQ ID NO: 22820
  SARS-CoV-2/Wuhan/WIV05/2019__EPI_ISL_402128 spike protein mRNA gc (1-1273)(A222V_D614G) R10276

SEQ ID NO: 23192 - RNA, 4039 nt, Artificial Sequence; identical to SEQ ID NO: 22822
  SARS-CoV-2/Wuhan/WIV05/2019__EPI_ISL_402128 spike protein mRNA gc (1-1273)(N439K_D614G) R10296

SEQ ID NO: 23193 - RNA, 4039 nt, Artificial Sequence; identical to SEQ ID NO: 22824
  SARS-CoV-2/Wuhan/WIV05/2019__EPI_ISL_402128 spike protein mRNA gc (1-1273)(S477N_D614G) R10284

SEQ ID NO: 23194 - RNA, 4039 nt, Artificial Sequence; identical to SEQ ID NO: 22826
  SARS-CoV-2/Wuhan/WIV05/2019__EPI_ISL_402128 spike protein mRNA gc (1-1273)(N501Y_D614G) R10350

SEQ ID NO: 23195 - RNA, 4033 nt, Artificial Sequence; identical to SEQ ID NO: 22828
  SARS-CoV-2/Wuhan/WIV05/2019__EPI_ISL_402128 spike protein mRNA gc (1-1273)(H69del_V70del_D614G) R10272

SEQ ID NO: 23196 - RNA, 4039 nt, Artificial Sequence; identical to SEQ ID NO: 22830
  SARS-CoV-2/Wuhan/WIV05/2019__EPI_ISL_402128 spike protein mRNA gc (1-1273)(Y453F_D614G) R10280

SEQ ID NO: 23197 - RNA, 4039 nt, Artificial Sequence; identical to SEQ ID NO: 22832
  SARS-CoV-2/Wuhan/WIV05/2019__EPI_ISL_402128 spike protein mRNA gc (1-1273)(D614G_I692V) R10288

SEQ ID NO: 23198 - RNA, 4039 nt, Artificial Sequence; identical to SEQ ID NO: 22834
  SARS-CoV-2/Wuhan/WIV05/2019__EPI_ISL_402128 spike protein mRNA gc (1-1273)(D614G_M1229I) R10344

SEQ ID NO: 23199 - RNA, 4033 nt, Artificial Sequence; identical to SEQ ID NO: 22836
  SARS-CoV-2/Wuhan/WIV05/2019__EPI_ISL_402128 spike protein mRNA gc (1-1273)(H69del_V70del_A222V_Y453F_S477N_D614G_I692V) R10292

SEQ ID NO: 23200 - RNA, 4033 nt, Artificial Sequence; identical to SEQ ID NO: 22838
  SARS-CoV-2/Wuhan/WIV05/2019__EPI_ISL_402128 spike protein mRNA gc (1-1273)(H69del_V70del_Y453F_D614G_I692V_M1229I) R10346

SEQ ID NO: 23201 - RNA, 4030 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H) R10352
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23202 - RNA, 4039 nt, Artificial Sequence
  SARS-CoV-2/Wuhan/WIV05/2019__EPI_ISL_402128 spike protein mRNA gc (1-1273)(K417N_E484K_N501Y_D614G) R10358
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23203 - RNA, 4030 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23204 - RNA, 4039 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23205 - RNA, 4039 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23206 - RNA, 4039 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23207 - RNA, 4039 nt, Artificial Sequence; identical to SEQ ID NO: 162
  SARS-CoV-2/Wuhan/WIV05/2019__EPI_ISL_402128 spike protein mRNA gc (1-1273) R9514

SEQ ID NO: 23208 - RNA, 4039 nt, Artificial Sequence; identical to SEQ ID NO: 12751
  SARS-CoV-2/Wuhan/WIV05/2019__EPI_ISL_402128 spike protein mRNA gc (1-1273)(D614G)

SEQ ID NO: 23209 - RNA, 4039 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23210 - RNA, 4039 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23211 - RNA, 4039 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23212 - RNA, 4039 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23213 - RNA, 4033 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacaagguggaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgccccgcacggggugguguuccuccacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagcccgugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23214 - RNA, 4039 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23215 - RNA, 4039 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23216 - RNA, 4039 nt, Artificial Sequence; identical to SEQ ID NO: 12796
  SARS-CoV-2/Wuhan/WIV05/2019__EPI_ISL_402128 spike protein mRNA gc (1-1273)(D614G_M1229I)

SEQ ID NO: 23217 - RNA, 4033 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacaagguggaggccgaggugcagaucgaccggcugaucaccggccgccuccagucccugcagaccuacgucacccagcagcugauccgggccgcggagauccgcgccagcgccaaccucgccgccaccaagaugagcgagugcgugcugggccaguccaagcggguggacuucugcgggaagggcuaccaccugaugagcuucccccaguccgcgccgcacggggucguguuccuccacgucacguacgugcccgcccaggagaagaacuucaccaccgcccccgccaucugccacgacggcaaggcgcacuucccccgcgaggggguguucgucagcaacggcacccacugguucgugacgcagcggaacuucuacgagccgcagaucaucaccaccgacaacaccuucguguccggcaacugcgacgucgugaucgggaucgugaacaacacggucuacgacccccugcagcccgagcuggacagcuucaaggaggagcucgacaaguacuucaagaaccacaccucccccgacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggccgugguacaucuggcugggcuucaucgccgggcugaucgccaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23218 - RNA, 4033 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23219 - RNA, 4030 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacaagguggaggccgagguccagaucgaccggcugaucacgggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucaccuacgugccggcccaggagaagaacuucacgaccgcccccgccaucugccacgacggcaaggcccacuucccccgcgagggggucuucgugagcaacggcacccacugguucgugacccagcggaacuucuacgagccccagaucaucacgacccacaacaccuucgucuccggcaacugcgacguggugaucgggaucgucaacaacaccguguacgacccgcugcagcccgagcuggacagcuucaaggaggagcucgacaaguacuucaagaaccacacgucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23220 - RNA, 4039 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23221 - RNA, 4030 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacaagguggaggccgaggugcagaucgaccgccugaucaccggccggcuccagagccugcagaccuacgucacccagcagcugauccgcgccgcggagauccgggccagcgccaaccucgccgccaccaagauguccgagugcgugcuggggcagagcaagcgcguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgggagggcguguucgucuccaacggcacccacugguucgugacgcagcgcaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccggcugaacgagguggccaagaaccucaacgagucccugaucgaccugcaggagcucggcaaguacgagcaguacaucaaguggccgugguacaucuggcugggguucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23222 - RNA, 4039 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23223 - RNA, 4039 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaucaagauguccgagugcguccucggccagagcaagcgcguggacuucugcgggaagggcuaccaccugauguccuucccccagagcgcgccccacgggguggucuuccugcacgugaccuacgucccggcccaggagaagaacuucacgaccgcccccgccaucugccacgacggcaaggcccacuucccccgggaggggguguucguguccaacggcacccacugguucgucacccagcgcaacuucuacgagccccagaucaucacgaccgacaacaccuucgugagcggcaacugcgacguggucaucgggaucgugaacaacaccguguacgacccgcuccagcccgagcuggacuccuucaaggaggagcuggacaaguacuucaagaaccacacgagccccgacgucgaccucggcgacaucuccgggaucaacgccagcguggugaacauccagaaggagaucgaccggcugaacgaggucgccaagaaccugaacgagucccucaucgaccugcaggagcugggcaaguacgagcaguacaucaaguggcccugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagccgguccugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23224 - RNA, 4039 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaccaagaugagcgagugcguccucggccaguccaagcgcguggacuucugcgggaagggcuaccaccugaugagcuucccccaguccgccccgcacgggguggucuuccugcacgugacguacguccccgcccaggagaagaacuucaccaccgcccccgcgaucugccacgacggcaaggcccacuucccccgggaggggguguucgugagcaacggcacccacugguucgucacgcagcgcaacuucuacgagccgcagaucaucaccaccgacaacaccuucguguccggcaacugcgacguggucaucgggaucgugaacaacacgguguacgacccccuccagcccgagcuggacagcuucaaggaggagcuggacaaguacuucaagaaccacaccucccccgacgucgaccucggcgacaucagcgggaucaacgccuccguggugaacauccagaaggagaucgaccggcugaacgaggucgccaagaaccugaacgagagccucaucgaccugcaggagcugggcaaguacgagcaguacaucaaguggccgugguacaucuggcucggcuucaucgccgggcugaucgcgaucgugauggugaccaucaugcugugcugcaugaccuccugcugcagcugccucaagggcugcugcuccugcgggagcugcugcaaguucgacgaggacgacuccgagcccguccugaagggcgugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23225 - RNA, 4039 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23226 - RNA, 4039 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23227 - RNA, 4039 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23228 - RNA, 4039 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23229 - RNA, 4039 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23230 - RNA, 4039 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23231 - RNA, 4033 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23232 - RNA, 4039 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23233 - RNA, 4039 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23234 - RNA, 4039 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23235 - RNA, 4033 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23236 - RNA, 4033 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23237 - RNA, 4030 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23238 - RNA, 4039 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23239 - RNA, 4030 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23240 - RNA, 4039 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23241 - RNA, 4039 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23242 - RNA, 4039 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23243 - RNA, 4039 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23244 - RNA, 4039 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23245 - RNA, 4039 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23246 - RNA, 4039 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23247 - RNA, 4039 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23248 - RNA, 4039 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23249 - RNA, 4033 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgugacauacguccccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23250 - RNA, 4039 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23251 - RNA, 4039 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23252 - RNA, 4039 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23253 - RNA, 4033 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgccccacacggcguggucuuccuccacgugacauacgugcccgcccaggagaagaacuucaccaccgcccccgccaucugccacgacggcaaggcccacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23254 - RNA, 4033 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23255 - RNA, 4030 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacaagguggaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgucccagcccaggagaagaacuucacaaccgcccccgccaucugccacgacggcaaggcccacuucccccgggagggaguguucgugagcaacggcacccacugguucgugacccagcggaacuucuacgagccccagaucaucaccacccacaacaccuucgugagcggcaacugcgacguggugaucggcaucgugaacaacaccguguacgacccccugcagcccgagcuggacagcuucaaggaggagcuggacaaguacuucaagaaccacaccagcccugacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23256 - RNA, 4039 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23257 - RNA, 4030 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggacaagguggaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgccccacacggcguggucuuccugcacgugacauacgugcccgcccaggagaagaacuucaccaccgcccccgccaucugccacgacggaaaggcccacuucccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcucgacaaguacuucaagaaccacaccagccccgacguggaccugggcgacaucagcggcaucaacgcuagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23258 - RNA, 4039 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23259 - RNA, 4039 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacaagguggaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgucaccuacgugccagcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccugacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23260 - RNA, 4039 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggacaagguggaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgccccacacggcgugguguuccugcacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23261 - RNA, 4039 nt, Artificial Sequence; identical to SEQ ID NO: 13012
  SARS-CoV-2/Wuhan/WIV05/2019__EPI_ISL_402128 spike protein mRNA gc mod (1-1273)

SEQ ID NO: 23262 - RNA, 4039 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23263 - RNA, 4039 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23264 - RNA, 4039 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23265 - RNA, 4039 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23266 - RNA, 4039 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23267 - RNA, 4033 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23268 - RNA, 4039 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23269 - RNA, 4039 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23270 - RNA, 4039 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23271 - RNA, 4033 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23272 - RNA, 4033 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23273 - RNA, 4030 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23274 - RNA, 4039 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23275 - RNA, 4030 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23276 - RNA, 4039 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23277 - RNA, 4039 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23278 - RNA, 4039 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23279 - RNA, 4039 nt, Artificial Sequence
  SARS-CoV-2/Wuhan/WIV05/2019__EPI_ISL_402128 spike protein mRNA gc mod (1-1273)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23280 - RNA, 4039 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23281 - RNA, 4039 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23282 - RNA, 4039 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23283 - RNA, 4039 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23284 - RNA, 4039 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23285 - RNA, 4033 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23286 - RNA, 4039 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23287 - RNA, 4039 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23288 - RNA, 4039 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23289 - RNA, 4033 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23290 - RNA, 4033 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23291 - RNA, 4030 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23292 - RNA, 4039 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23293 - RNA, 4030 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23294 - RNA, 4039 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23295 - RNA, 4039 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23296 - RNA, 4039 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23297 - RNA, 4039 nt, Artificial Sequence; identical to SEQ ID NO: 163
  SARS-CoV-2/Wuhan/WIV05/2019__EPI_ISL_402128 spike protein mRNA gc (1-1273)(K986P_V987P) R9515, R10157

SEQ ID NO: 23298 - RNA, 4039 nt, Artificial Sequence; identical to SEQ ID NO: 22819
  SARS-CoV-2/Wuhan/WIV05/2019__EPI_ISL_402128 spike protein mRNA gc (1-1273)(K986P_V987P_ D614G) R10165

SEQ ID NO: 23299 - RNA, 4039 nt, Artificial Sequence; identical to SEQ ID NO: 22821
  SARS-CoV-2/Wuhan/WIV05/2019__EPI_ISL_402128 spike protein mRNA gc (1-1273)(K986P_V987P_A222V_D614G) R10277

SEQ ID NO: 23300 - RNA, 4039 nt, Artificial Sequence; identical to SEQ ID NO: 22823
  SARS-CoV-2/Wuhan/WIV05/2019__EPI_ISL_402128 spike protein mRNA gc (1-1273)(K986P_V987P_N439K_D614G) R10297

SEQ ID NO: 23301 - RNA, 4039 nt, Artificial Sequence; identical to SEQ ID NO: 22825
  SARS-CoV-2/Wuhan/WIV05/2019__EPI_ISL_402128 spike protein mRNA gc (1-1273)(K986P_V987P_S477N_D614G) R10285

SEQ ID NO: 23302 - RNA, 4039 nt, Artificial Sequence; identical to SEQ ID NO: 22827
  SARS-CoV-2/Wuhan/WIV05/2019__EPI_ISL_402128 spike protein mRNA gc (1-1273)(K986P_V987P_N501Y_D614G) R10351

SEQ ID NO: 23303 - RNA, 4033 nt, Artificial Sequence; identical to SEQ ID NO: 22829
  SARS-CoV-2/Wuhan/WIV05/2019__EPI_ISL_402128 spike protein mRNA gc (1-1273)(K986P_V987P_H69del_V70del_D614G) R10273

SEQ ID NO: 23304 - RNA, 4039 nt, Artificial Sequence; identical to SEQ ID NO: 22831
  SARS-CoV-2/Wuhan/WIV05/2019__EPI_ISL_402128 spike protein mRNA gc (1-1273)(K986P_V987P_Y453F_D614G) R10281

SEQ ID NO: 23305 - RNA, 4039 nt, Artificial Sequence; identical to SEQ ID NO: 22833
  SARS-CoV-2/Wuhan/WIV05/2019__EPI_ISL_402128 spike protein mRNA gc (1-1273)(K986P_V987P_D614G_I692V) R10289

SEQ ID NO: 23306 - RNA, 4039 nt, Artificial Sequence; identical to SEQ ID NO: 22835
  SARS-CoV-2/Wuhan/WIV05/2019__EPI_ISL_402128 spike protein mRNA gc (1-1273)(K986P_V987P_D614G_M1229I) R10345

SEQ ID NO: 23307 - RNA, 4033 nt, Artificial Sequence; identical to SEQ ID NO: 22837
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V) R10293

SEQ ID NO: 23308 - RNA, 4033 nt, Artificial Sequence; identical to SEQ ID NO: 22839
  SARS-CoV-2/Wuhan/WIV05/2019__EPI_ISL_402128 spike protein mRNA gc (1-1273)(K986P_V987P_H69del_V70del_Y453F_D614G_I692V_M1229I) R10347

SEQ ID NO: 23309 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H) R10353
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23310 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G) R10360
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23311 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V) R10379
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23312 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G) R10378
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23313 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I) R10380
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23314 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G) R10381
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23315 - RNA, 4039 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23316 - RNA, 4039 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23317 - RNA, 4039 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23318 - RNA, 4039 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23319 - RNA, 4039 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23320 - RNA, 4039 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23321 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23322 - RNA, 4039 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23323 - RNA, 4039 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23324 - RNA, 4039 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23325 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23326 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23327 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23328 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23329 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23330 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23331 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23332 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23333 - RNA, 4039 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23334 - RNA, 4039 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23335 - RNA, 4039 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23336 - RNA, 4039 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23337 - RNA, 4039 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23338 - RNA, 4039 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23339 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23340 - RNA, 4039 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23341 - RNA, 4039 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23342 - RNA, 4039 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23343 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23344 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23345 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23346 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23347 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23348 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23349 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23350 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23351 - RNA, 4039 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23352 - RNA, 4039 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23353 - RNA, 4039 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23354 - RNA, 4039 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23355 - RNA, 4039 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23356 - RNA, 4039 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23357 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23358 - RNA, 4039 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23359 - RNA, 4039 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23360 - RNA, 4039 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23361 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23362 - RNA, 4033 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23363 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23364 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23365 - RNA, 4030 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23366 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23367 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23368 - RNA, 4039 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23369 - RNA, 4039 nt, Artificial Sequence; identical to SEQ ID NO: 165
  SARS-CoV-2/Wuhan/WIV05/2019__EPI_ISL_402128 spike protein mRNA gc mod (1-1273)(K986P_V987P) R9519

SEQ ID NO: 23370 - RNA, 4039 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23371 - RNA, 4039 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23372 - RNA, 4039 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23373 - RNA, 4039 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23374 - RNA, 4039 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23375 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23376 - RNA, 4039 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23377 - RNA, 4039 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23378 - RNA, 4039 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23379 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23380 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23381 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23382 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23383 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23384 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23385 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23386 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23387 - RNA, 4039 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23388 - RNA, 4039 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23389 - RNA, 4039 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23390 - RNA, 4039 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23391 - RNA, 4039 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23392 - RNA, 4039 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23393 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23394 - RNA, 4039 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23395 - RNA, 4039 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23396 - RNA, 4039 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23397 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23398 - RNA, 4033 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23399 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23400 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23401 - RNA, 4030 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23402 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23403 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23404 - RNA, 4039 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 23405 - RNA, 1424 nt, Artificial Sequence; identical to SEQ ID NO: 22787
  SARS-CoV-2/Wuhan/WIV05/2019__EPI_ISL_402128 spike protein mRNA gc (1-15,334-528) Ferritin construct R10340

SEQ ID NO: 23406 - RNA, 1022 nt, Artificial Sequence; identical to SEQ ID NO: 22788
  SARS-CoV-2/Wuhan/WIV05/2019__EPI_ISL_402128 spike protein mRNA gc (334-528) Foldon construct R9927

SEQ ID NO: 23407 - RNA, 1400 nt, Artificial Sequence; identical to SEQ ID NO: 22789
  SARS-CoV-2/Wuhan/WIV05/2019__EPI_ISL_402128 spike protein mRNA gc (1-15,334-528) LumSynth construct R10338

SEQ ID NO: 23408 - RNA, 1361 nt, Artificial Sequence; identical to SEQ ID NO: 22790
  SARS-CoV-2/Wuhan/WIV05/2019__EPI_ISL_402128 spike protein mRNA gc (334-528) LumSynth construct R10339

SEQ ID NO: 23409 - RNA, 4094 nt, Artificial Sequence; identical to SEQ ID NO: 148
  SARS-CoV-2/Wuhan/WIV05/2019__EPI_ISL_402128 spike protein mRNA gc (1-1273) R9488, R9492, R10161

SEQ ID NO: 23410 - RNA, 4094 nt, Artificial Sequence; identical to SEQ ID NO: 22791
  SARS-CoV-2/Wuhan/WIV05/2019__EPI_ISL_402128 spike protein mRNA gc (1-1273)(D614G) R10182

SEQ ID NO: 23411 - RNA, 4094 nt, Artificial Sequence; identical to SEQ ID NO: 22793
  SARS-CoV-2/Wuhan/WIV05/2019__EPI_ISL_402128 spike protein mRNA gc (1-1273)(A222V_D614G) R10278

SEQ ID NO: 23412 - RNA, 4094 nt, Artificial Sequence; identical to SEQ ID NO: 22795
  SARS-CoV-2/Wuhan/WIV05/2019__EPI_ISL_402128 spike protein mRNA gc (1-1273)(N439K_D614G) R10298

SEQ ID NO: 23413 - RNA, 4094 nt, Artificial Sequence; identical to SEQ ID NO: 22797
  SARS-CoV-2/Wuhan/WIV05/2019__EPI_ISL_402128 spike protein mRNA gc (1-1273)(S477N_D614G) R10287

SEQ ID NO: 23414 - RNA, 4094 nt, Artificial Sequence; identical to SEQ ID NO: 22799
  SARS-CoV-2/Wuhan/WIV05/2019__EPI_ISL_402128 spike protein mRNA gc (1-1273)(N501Y_D614G)

SEQ ID NO: 23415 - RNA, 4088 nt, Artificial Sequence; identical to SEQ ID NO: 22801
  SARS-CoV-2/Wuhan/WIV05/2019__EPI_ISL_402128 spike protein mRNA gc (1-1273)(H69del_V70del_D614G) R10274

SEQ ID NO: 23416 - RNA, 4094 nt, Artificial Sequence; identical to SEQ ID NO: 22803
  SARS-CoV-2/Wuhan/WIV05/2019__EPI_ISL_402128 spike protein mRNA gc (1-1273)(Y453F_D614G) R10282

SEQ ID NO: 23417 - RNA, 4094 nt, Artificial Sequence; identical to SEQ ID NO: 22805
  SARS-CoV-2/Wuhan/WIV05/2019__EPI_ISL_402128 spike protein mRNA gc (1-1273)(D614G_I692V) R10290

SEQ ID NO: 23418 - RNA, 4094 nt, Artificial Sequence; identical to SEQ ID NO: 22807
  SARS-CoV-2/Wuhan/WIV05/2019__EPI_ISL_402128 spike protein mRNA gc (1-1273)(D614G_M1229I)

SEQ ID NO: 23419 - RNA, 4088 nt, Artificial Sequence; identical to SEQ ID NO: 22809
  SARS-CoV-2/Wuhan/WIV05/2019__EPI_ISL_402128 spike protein mRNA gc (1-1273)(H69del_V70del_A222V_Y453F_S477N_D614G_I692V) R10294

SEQ ID NO: 23420 - RNA, 4088 nt, Artificial Sequence; identical to SEQ ID NO: 22811
  SARS-CoV-2/Wuhan/WIV05/2019__EPI_ISL_402128 spike protein mRNA gc (1-1273)(H69del_V70del_Y453F_D614G_I692V_M1229I)

SEQ ID NO: 23421 - RNA, 4085 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H) R10356
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23422 - RNA, 4094 nt, Artificial Sequence
  SARS-CoV-2/Wuhan/WIV05/2019__EPI_ISL_402128 spike protein mRNA gc (1-1273)(K417N_E484K_N501Y_D614G) R10359
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23423 - RNA, 4085 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23424 - RNA, 4094 nt, Artificial Sequence
  SARS-CoV-2/Wuhan/WIV05/2019__EPI_ISL_402128 spike protein mRNA gc (1-1273)(E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23425 - RNA, 4094 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23426 - RNA, 4094 nt, Artificial Sequence
  SARS-CoV-2/Wuhan/WIV05/2019__EPI_ISL_402128 spike protein mRNA gc (1-1273)(S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23427 - RNA, 4094 nt, Artificial Sequence; identical to SEQ ID NO: 148
  SARS-CoV-2/Wuhan/WIV05/2019__EPI_ISL_402128 spike protein mRNA gc (1-1273) R9488, R9492, R10161

SEQ ID NO: 23428 - RNA, 4094 nt, Artificial Sequence; identical to SEQ ID NO: 12279
  SARS-CoV-2/Wuhan/WIV05/2019__EPI_ISL_402128 spike protein mRNA gc (1-1273)(D614G)

SEQ ID NO: 23429 - RNA, 4094 nt, Artificial Sequence
  SARS-CoV-2/Wuhan/WIV05/2019__EPI_ISL_402128 spike protein mRNA gc (1-1273)(A222V_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23430 - RNA, 4094 nt, Artificial Sequence
  SARS-CoV-2/Wuhan/WIV05/2019__EPI_ISL_402128 spike protein mRNA gc (1-1273)(N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23431 - RNA, 4094 nt, Artificial Sequence
  SARS-CoV-2/Wuhan/WIV05/2019__EPI_ISL_402128 spike protein mRNA gc (1-1273)(S477N_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23432 - RNA, 4094 nt, Artificial Sequence
  SARS-CoV-2/Wuhan/WIV05/2019__EPI_ISL_402128 spike protein mRNA gc (1-1273)(N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23433 - RNA, 4088 nt, Artificial Sequence
  SARS-CoV-2/Wuhan/WIV05/2019__EPI_ISL_402128 spike protein mRNA gc (1-1273)(H69del_V70del_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacaagguggaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgccccgcacggggugguguuccuccacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagcccgugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23434 - RNA, 4094 nt, Artificial Sequence
  SARS-CoV-2/Wuhan/WIV05/2019__EPI_ISL_402128 spike protein mRNA gc (1-1273)(Y453F_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23435 - RNA, 4094 nt, Artificial Sequence
  SARS-CoV-2/Wuhan/WIV05/2019__EPI_ISL_402128 spike protein mRNA gc (1-1273)(D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23436 - RNA, 4094 nt, Artificial Sequence; identical to SEQ ID NO: 12324
  SARS-CoV-2/Wuhan/WIV05/2019__EPI_ISL_402128 spike protein mRNA gc (1-1273)(D614G_M1229I)

SEQ ID NO: 23437 - RNA, 4088 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacaagguggaggccgaggugcagaucgaccggcugaucaccggccgccuccagucccugcagaccuacgucacccagcagcugauccgggccgcggagauccgcgccagcgccaaccucgccgccaccaagaugagcgagugcgugcugggccaguccaagcggguggacuucugcgggaagggcuaccaccugaugagcuucccccaguccgcgccgcacggggucguguuccuccacgucacguacgugcccgcccaggagaagaacuucaccaccgcccccgccaucugccacgacggcaaggcgcacuucccccgcgaggggguguucgucagcaacggcacccacugguucgugacgcagcggaacuucuacgagccgcagaucaucaccaccgacaacaccuucguguccggcaacugcgacgucgugaucgggaucgugaacaacacggucuacgacccccugcagcccgagcuggacagcuucaaggaggagcucgacaaguacuucaagaaccacaccucccccgacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggccgugguacaucuggcugggcuucaucgccgggcugaucgccaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23438 - RNA, 4088 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23439 - RNA, 4085 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacaagguggaggccgagguccagaucgaccggcugaucacgggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucaccuacgugccggcccaggagaagaacuucacgaccgcccccgccaucugccacgacggcaaggcccacuucccccgcgagggggucuucgugagcaacggcacccacugguucgugacccagcggaacuucuacgagccccagaucaucacgacccacaacaccuucgucuccggcaacugcgacguggugaucgggaucgucaacaacaccguguacgacccgcugcagcccgagcuggacagcuucaaggaggagcucgacaaguacuucaagaaccacacgucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23440 - RNA, 4094 nt, Artificial Sequence
  SARS-CoV-2/Wuhan/WIV05/2019__EPI_ISL_402128 spike protein mRNA gc (1-1273)(K417N_E484K_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23441 - RNA, 4085 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacaagguggaggccgaggugcagaucgaccgccugaucaccggccggcuccagagccugcagaccuacgucacccagcagcugauccgcgccgcggagauccgggccagcgccaaccucgccgccaccaagauguccgagugcgugcuggggcagagcaagcgcguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgggagggcguguucgucuccaacggcacccacugguucgugacgcagcgcaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccggcugaacgagguggccaagaaccucaacgagucccugaucgaccugcaggagcucggcaaguacgagcaguacaucaaguggccgugguacaucuggcugggguucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23442 - RNA, 4094 nt, Artificial Sequence
  SARS-CoV-2/Wuhan/WIV05/2019__EPI_ISL_402128 spike protein mRNA gc (1-1273)(E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23443 - RNA, 4094 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaucaagauguccgagugcguccucggccagagcaagcgcguggacuucugcgggaagggcuaccaccugauguccuucccccagagcgcgccccacgggguggucuuccugcacgugaccuacgucccggcccaggagaagaacuucacgaccgcccccgccaucugccacgacggcaaggcccacuucccccgggaggggguguucguguccaacggcacccacugguucgucacccagcgcaacuucuacgagccccagaucaucacgaccgacaacaccuucgugagcggcaacugcgacguggucaucgggaucgugaacaacaccguguacgacccgcuccagcccgagcuggacuccuucaaggaggagcuggacaaguacuucaagaaccacacgagccccgacgucgaccucggcgacaucuccgggaucaacgccagcguggugaacauccagaaggagaucgaccggcugaacgaggucgccaagaaccugaacgagucccucaucgaccugcaggagcugggcaaguacgagcaguacaucaaguggcccugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagccgguccugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23444 - RNA, 4094 nt, Artificial Sequence
  SARS-CoV-2/Wuhan/WIV05/2019__EPI_ISL_402128 spike protein mRNA gc (1-1273)(S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaccaagaugagcgagugcguccucggccaguccaagcgcguggacuucugcgggaagggcuaccaccugaugagcuucccccaguccgccccgcacgggguggucuuccugcacgugacguacguccccgcccaggagaagaacuucaccaccgcccccgcgaucugccacgacggcaaggcccacuucccccgggaggggguguucgugagcaacggcacccacugguucgucacgcagcgcaacuucuacgagccgcagaucaucaccaccgacaacaccuucguguccggcaacugcgacguggucaucgggaucgugaacaacacgguguacgacccccuccagcccgagcuggacagcuucaaggaggagcuggacaaguacuucaagaaccacaccucccccgacgucgaccucggcgacaucagcgggaucaacgccuccguggugaacauccagaaggagaucgaccggcugaacgaggucgccaagaaccugaacgagagccucaucgaccugcaggagcugggcaaguacgagcaguacaucaaguggccgugguacaucuggcucggcuucaucgccgggcugaucgcgaucgugauggugaccaucaugcugugcugcaugaccuccugcugcagcugccucaagggcugcugcuccugcgggagcugcugcaaguucgacgaggacgacuccgagcccguccugaagggcgugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23445 - RNA, 4094 nt, Artificial Sequence
  SARS-CoV-2/Wuhan/WIV05/2019__EPI_ISL_402128 spike protein mRNA gc (1-1273)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23446 - RNA, 4094 nt, Artificial Sequence
  SARS-CoV-2/Wuhan/WIV05/2019__EPI_ISL_402128 spike protein mRNA gc (1-1273)(D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23447 - RNA, 4094 nt, Artificial Sequence
  SARS-CoV-2/Wuhan/WIV05/2019__EPI_ISL_402128 spike protein mRNA gc (1-1273)(A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23448 - RNA, 4094 nt, Artificial Sequence
  SARS-CoV-2/Wuhan/WIV05/2019__EPI_ISL_402128 spike protein mRNA gc (1-1273)(N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23449 - RNA, 4094 nt, Artificial Sequence
  SARS-CoV-2/Wuhan/WIV05/2019__EPI_ISL_402128 spike protein mRNA gc (1-1273)(S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23450 - RNA, 4094 nt, Artificial Sequence
  SARS-CoV-2/Wuhan/WIV05/2019__EPI_ISL_402128 spike protein mRNA gc (1-1273)(N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23451 - RNA, 4088 nt, Artificial Sequence
  SARS-CoV-2/Wuhan/WIV05/2019__EPI_ISL_402128 spike protein mRNA gc (1-1273)(H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23452 - RNA, 4094 nt, Artificial Sequence
  SARS-CoV-2/Wuhan/WIV05/2019__EPI_ISL_402128 spike protein mRNA gc (1-1273)(Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23453 - RNA, 4094 nt, Artificial Sequence
  SARS-CoV-2/Wuhan/WIV05/2019__EPI_ISL_402128 spike protein mRNA gc (1-1273)(D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23454 - RNA, 4094 nt, Artificial Sequence
  SARS-CoV-2/Wuhan/WIV05/2019__EPI_ISL_402128 spike protein mRNA gc (1-1273)(D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23455 - RNA, 4088 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23456 - RNA, 4088 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23457 - RNA, 4085 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23458 - RNA, 4094 nt, Artificial Sequence
  SARS-CoV-2/Wuhan/WIV05/2019__EPI_ISL_402128 spike protein mRNA gc (1-1273)(K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23459 - RNA, 4085 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23460 - RNA, 4094 nt, Artificial Sequence
  SARS-CoV-2/Wuhan/WIV05/2019__EPI_ISL_402128 spike protein mRNA gc (1-1273)(E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23461 - RNA, 4094 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23462 - RNA, 4094 nt, Artificial Sequence
  SARS-CoV-2/Wuhan/WIV05/2019__EPI_ISL_402128 spike protein mRNA gc (1-1273)(S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23463 - RNA, 4094 nt, Artificial Sequence
  SARS-CoV-2/Wuhan/WIV05/2019__EPI_ISL_402128 spike protein mRNA gc (1-1273)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23464 - RNA, 4094 nt, Artificial Sequence
  SARS-CoV-2/Wuhan/WIV05/2019__EPI_ISL_402128 spike protein mRNA gc (1-1273)(D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23465 - RNA, 4094 nt, Artificial Sequence
  SARS-CoV-2/Wuhan/WIV05/2019__EPI_ISL_402128 spike protein mRNA gc (1-1273)(A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23466 - RNA, 4094 nt, Artificial Sequence
  SARS-CoV-2/Wuhan/WIV05/2019__EPI_ISL_402128 spike protein mRNA gc (1-1273)(N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23467 - RNA, 4094 nt, Artificial Sequence
  SARS-CoV-2/Wuhan/WIV05/2019__EPI_ISL_402128 spike protein mRNA gc (1-1273)(S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23468 - RNA, 4094 nt, Artificial Sequence
  SARS-CoV-2/Wuhan/WIV05/2019__EPI_ISL_402128 spike protein mRNA gc (1-1273)(N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23469 - RNA, 4088 nt, Artificial Sequence
  SARS-CoV-2/Wuhan/WIV05/2019__EPI_ISL_402128 spike protein mRNA gc (1-1273)(H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgugacauacguccccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23470 - RNA, 4094 nt, Artificial Sequence
  SARS-CoV-2/Wuhan/WIV05/2019__EPI_ISL_402128 spike protein mRNA gc (1-1273)(Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23471 - RNA, 4094 nt, Artificial Sequence
  SARS-CoV-2/Wuhan/WIV05/2019__EPI_ISL_402128 spike protein mRNA gc (1-1273)(D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23472 - RNA, 4094 nt, Artificial Sequence
  SARS-CoV-2/Wuhan/WIV05/2019__EPI_ISL_402128 spike protein mRNA gc (1-1273)(D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23473 - RNA, 4088 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgccccacacggcguggucuuccuccacgugacauacgugcccgcccaggagaagaacuucaccaccgcccccgccaucugccacgacggcaaggcccacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23474 - RNA, 4088 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23475 - RNA, 4085 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacaagguggaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgucccagcccaggagaagaacuucacaaccgcccccgccaucugccacgacggcaaggcccacuucccccgggagggaguguucgugagcaacggcacccacugguucgugacccagcggaacuucuacgagccccagaucaucaccacccacaacaccuucgugagcggcaacugcgacguggugaucggcaucgugaacaacaccguguacgacccccugcagcccgagcuggacagcuucaaggaggagcuggacaaguacuucaagaaccacaccagcccugacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23476 - RNA, 4094 nt, Artificial Sequence
  SARS-CoV-2/Wuhan/WIV05/2019__EPI_ISL_402128 spike protein mRNA gc (1-1273)(K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23477 - RNA, 4085 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggacaagguggaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgccccacacggcguggucuuccugcacgugacauacgugcccgcccaggagaagaacuucaccaccgcccccgccaucugccacgacggaaaggcccacuucccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcucgacaaguacuucaagaaccacaccagccccgacguggaccugggcgacaucagcggcaucaacgcuagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23478 - RNA, 4094 nt, Artificial Sequence
  SARS-CoV-2/Wuhan/WIV05/2019__EPI_ISL_402128 spike protein mRNA gc (1-1273)(E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23479 - RNA, 4094 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacaagguggaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgucaccuacgugccagcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccugacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23480 - RNA, 4094 nt, Artificial Sequence
  SARS-CoV-2/Wuhan/WIV05/2019__EPI_ISL_402128 spike protein mRNA gc (1-1273)(S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggacaagguggaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgccccacacggcgugguguuccugcacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23481 - RNA, 4094 nt, Artificial Sequence; identical to SEQ ID NO: 12540
  SARS-CoV-2/Wuhan/WIV05/2019__EPI_ISL_402128 spike protein mRNA gc mod (1-1273)

SEQ ID NO: 23482 - RNA, 4094 nt, Artificial Sequence
  SARS-CoV-2/Wuhan/WIV05/2019__EPI_ISL_402128 spike protein mRNA gc mod (1-1273)(D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23483 - RNA, 4094 nt, Artificial Sequence
  SARS-CoV-2/Wuhan/WIV05/2019__EPI_ISL_402128 spike protein mRNA gc mod (1-1273)(A222V_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23484 - RNA, 4094 nt, Artificial Sequence
  SARS-CoV-2/Wuhan/WIV05/2019__EPI_ISL_402128 spike protein mRNA gc mod (1-1273)(N439K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23485 - RNA, 4094 nt, Artificial Sequence
  SARS-CoV-2/Wuhan/WIV05/2019__EPI_ISL_402128 spike protein mRNA gc mod (1-1273)(S477N_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23486 - RNA, 4094 nt, Artificial Sequence
  SARS-CoV-2/Wuhan/WIV05/2019__EPI_ISL_402128 spike protein mRNA gc mod (1-1273)(N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23487 - RNA, 4088 nt, Artificial Sequence
  SARS-CoV-2/Wuhan/WIV05/2019__EPI_ISL_402128 spike protein mRNA gc mod (1-1273)(H69del_V70del_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23488 - RNA, 4094 nt, Artificial Sequence
  SARS-CoV-2/Wuhan/WIV05/2019__EPI_ISL_402128 spike protein mRNA gc mod (1-1273)(Y453F_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23489 - RNA, 4094 nt, Artificial Sequence
  SARS-CoV-2/Wuhan/WIV05/2019__EPI_ISL_402128 spike protein mRNA gc mod (1-1273)(D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23490 - RNA, 4094 nt, Artificial Sequence
  SARS-CoV-2/Wuhan/WIV05/2019__EPI_ISL_402128 spike protein mRNA gc mod (1-1273)(D614G_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23491 - RNA, 4088 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23492 - RNA, 4088 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23493 - RNA, 4085 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23494 - RNA, 4094 nt, Artificial Sequence
  SARS-CoV-2/Wuhan/WIV05/2019__EPI_ISL_402128 spike protein mRNA gc mod (1-1273)(K417N_E484K_N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23495 - RNA, 4085 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagagucccgcagucggcguccagcggcucugcuuguucgugugugugucguugcaggccuuauucaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23496 - RNA, 4094 nt, Artificial Sequence
  SARS-CoV-2/Wuhan/WIV05/2019__EPI_ISL_402128 spike protein mRNA gc mod (1-1273)(E484K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23497 - RNA, 4094 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagagucccgcagucggcguccagcggcucugcuuguucgugugugugucguugcaggccuuauucaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23498 - RNA, 4094 nt, Artificial Sequence
  SARS-CoV-2/Wuhan/WIV05/2019__EPI_ISL_402128 spike protein mRNA gc mod (1-1273)(S13I_W152C_L452R_D614G)
aggagagucccgcagucggcguccagcggcucugcuuguucgugugugugucguugcaggccuuauucaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23499 - RNA, 4094 nt, Artificial Sequence
  SARS-CoV-2/Wuhan/WIV05/2019__EPI_ISL_402128 spike protein mRNA gc mod (1-1273)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23500 - RNA, 4094 nt, Artificial Sequence
  SARS-CoV-2/Wuhan/WIV05/2019__EPI_ISL_402128 spike protein mRNA gc mod (1-1273)(D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23501 - RNA, 4094 nt, Artificial Sequence
  SARS-CoV-2/Wuhan/WIV05/2019__EPI_ISL_402128 spike protein mRNA gc mod (1-1273)(A222V_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23502 - RNA, 4094 nt, Artificial Sequence
  SARS-CoV-2/Wuhan/WIV05/2019__EPI_ISL_402128 spike protein mRNA gc mod (1-1273)(N439K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23503 - RNA, 4094 nt, Artificial Sequence
  SARS-CoV-2/Wuhan/WIV05/2019__EPI_ISL_402128 spike protein mRNA gc mod (1-1273)(S477N_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23504 - RNA, 4094 nt, Artificial Sequence
  SARS-CoV-2/Wuhan/WIV05/2019__EPI_ISL_402128 spike protein mRNA gc mod (1-1273)(N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23505 - RNA, 4088 nt, Artificial Sequence
  SARS-CoV-2/Wuhan/WIV05/2019__EPI_ISL_402128 spike protein mRNA gc mod (1-1273)(H69del_V70del_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23506 - RNA, 4094 nt, Artificial Sequence
  SARS-CoV-2/Wuhan/WIV05/2019__EPI_ISL_402128 spike protein mRNA gc mod (1-1273)(Y453F_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23507 - RNA, 4094 nt, Artificial Sequence
  SARS-CoV-2/Wuhan/WIV05/2019__EPI_ISL_402128 spike protein mRNA gc mod (1-1273)(D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23508 - RNA, 4094 nt, Artificial Sequence
  SARS-CoV-2/Wuhan/WIV05/2019__EPI_ISL_402128 spike protein mRNA gc mod (1-1273)(D614G_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23509 - RNA, 4088 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23510 - RNA, 4088 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23511 - RNA, 4085 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23512 - RNA, 4094 nt, Artificial Sequence
  SARS-CoV-2/Wuhan/WIV05/2019__EPI_ISL_402128 spike protein mRNA gc mod (1-1273)(K417N_E484K_N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23513 - RNA, 4085 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagagucccgcagucggcguccagcggcucugcuuguucgugugugugucguugcaggccuuauucaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23514 - RNA, 4094 nt, Artificial Sequence
  SARS-CoV-2/Wuhan/WIV05/2019__EPI_ISL_402128 spike protein mRNA gc mod (1-1273)(E484K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23515 - RNA, 4094 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagagucccgcagucggcguccagcggcucugcuuguucgugugugugucguugcaggccuuauucaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23516 - RNA, 4094 nt, Artificial Sequence
  SARS-CoV-2/Wuhan/WIV05/2019__EPI_ISL_402128 spike protein mRNA gc mod (1-1273)(S13I_W152C_L452R_D614G)
aggagagucccgcagucggcguccagcggcucugcuuguucgugugugugucguugcaggccuuauucaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23517 - RNA, 4094 nt, Artificial Sequence; identical to SEQ ID NO: 149
  SARS-CoV-2/Wuhan/WIV05/2019__EPI_ISL_402128 spike protein mRNA gc (1-1273)(K986P_V987P) R9487, R9491, R9709, R10159, R10160

SEQ ID NO: 23518 - RNA, 4094 nt, Artificial Sequence; identical to SEQ ID NO: 22792
  SARS-CoV-2/Wuhan/WIV05/2019__EPI_ISL_402128 spike protein mRNA gc (1-1273)(K986P_V987P_ D614G) R10166

SEQ ID NO: 23519 - RNA, 4094 nt, Artificial Sequence; identical to SEQ ID NO: 22794
  SARS-CoV-2/Wuhan/WIV05/2019__EPI_ISL_402128 spike protein mRNA gc (1-1273)(K986P_V987P_A222V_D614G) R10279

SEQ ID NO: 23520 - RNA, 4094 nt, Artificial Sequence; identical to SEQ ID NO: 22796
  SARS-CoV-2/Wuhan/WIV05/2019__EPI_ISL_402128 spike protein mRNA gc (1-1273)(K986P_V987P_N439K_D614G) R10299

SEQ ID NO: 23521 - RNA, 4094 nt, Artificial Sequence; identical to SEQ ID NO: 22798
  SARS-CoV-2/Wuhan/WIV05/2019__EPI_ISL_402128 spike protein mRNA gc (1-1273)(K986P_V987P_S477N_D614G) R10286

SEQ ID NO: 23522 - RNA, 4094 nt, Artificial Sequence; identical to SEQ ID NO: 22800
  SARS-CoV-2/Wuhan/WIV05/2019__EPI_ISL_402128 spike protein mRNA gc (1-1273)(K986P_V987P_N501Y_D614G)

SEQ ID NO: 23523 - RNA, 4088 nt, Artificial Sequence; identical to SEQ ID NO: 22802
  SARS-CoV-2/Wuhan/WIV05/2019__EPI_ISL_402128 spike protein mRNA gc (1-1273)(K986P_V987P_H69del_V70del_D614G) R10275

SEQ ID NO: 23524 - RNA, 4094 nt, Artificial Sequence; identical to SEQ ID NO: 22804
  SARS-CoV-2/Wuhan/WIV05/2019__EPI_ISL_402128 spike protein mRNA gc (1-1273)(K986P_V987P_Y453F_D614G) R10283

SEQ ID NO: 23525 - RNA, 4094 nt, Artificial Sequence; identical to SEQ ID NO: 22806
  SARS-CoV-2/Wuhan/WIV05/2019__EPI_ISL_402128 spike protein mRNA gc (1-1273)(K986P_V987P_D614G_I692V) R10291

SEQ ID NO: 23526 - RNA, 4094 nt, Artificial Sequence; identical to SEQ ID NO: 22808
  SARS-CoV-2/Wuhan/WIV05/2019__EPI_ISL_402128 spike protein mRNA gc (1-1273)(K986P_V987P_D614G_M1229I)

SEQ ID NO: 23527 - RNA, 4088 nt, Artificial Sequence; identical to SEQ ID NO: 22810
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V) R10295

SEQ ID NO: 23528 - RNA, 4088 nt, Artificial Sequence; identical to SEQ ID NO: 22812
  SARS-CoV-2/Wuhan/WIV05/2019__EPI_ISL_402128 spike protein mRNA gc (1-1273)(K986P_V987P_H69del_V70del_Y453F_D614G_I692V_M1229I)

SEQ ID NO: 23529 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H) R10357
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23530 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G) R10361
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23531 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V) R10384
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23532 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23533 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I) R10385
aggagagucccgcagucggcguccagcggcucugcuuguucgugugugugucguugcaggccuuauucaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23534 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23535 - RNA, 4094 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23536 - RNA, 4094 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23537 - RNA, 4094 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23538 - RNA, 4094 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23539 - RNA, 4094 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23540 - RNA, 4094 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23541 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23542 - RNA, 4094 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23543 - RNA, 4094 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23544 - RNA, 4094 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23545 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23546 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23547 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23548 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23549 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23550 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23551 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23552 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23553 - RNA, 4094 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23554 - RNA, 4094 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23555 - RNA, 4094 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23556 - RNA, 4094 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23557 - RNA, 4094 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23558 - RNA, 4094 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23559 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23560 - RNA, 4094 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23561 - RNA, 4094 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23562 - RNA, 4094 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23563 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23564 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23565 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23566 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23567 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23568 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23569 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23570 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23571 - RNA, 4094 nt, Artificial Sequence
  SARS-CoV-2/Wuhan/WIV05/2019__EPI_ISL_402128 spike protein mRNA gc (1-1273)(K986P_V987P)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23572 - RNA, 4094 nt, Artificial Sequence
  SARS-CoV-2/Wuhan/WIV05/2019__EPI_ISL_402128 spike protein mRNA gc (1-1273)(K986P_V987P_ D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23573 - RNA, 4094 nt, Artificial Sequence
  SARS-CoV-2/Wuhan/WIV05/2019__EPI_ISL_402128 spike protein mRNA gc (1-1273)(K986P_V987P_A222V_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23574 - RNA, 4094 nt, Artificial Sequence
  SARS-CoV-2/Wuhan/WIV05/2019__EPI_ISL_402128 spike protein mRNA gc (1-1273)(K986P_V987P_N439K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23575 - RNA, 4094 nt, Artificial Sequence
  SARS-CoV-2/Wuhan/WIV05/2019__EPI_ISL_402128 spike protein mRNA gc (1-1273)(K986P_V987P_S477N_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23576 - RNA, 4094 nt, Artificial Sequence
  SARS-CoV-2/Wuhan/WIV05/2019__EPI_ISL_402128 spike protein mRNA gc (1-1273)(K986P_V987P_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23577 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23578 - RNA, 4094 nt, Artificial Sequence
  SARS-CoV-2/Wuhan/WIV05/2019__EPI_ISL_402128 spike protein mRNA gc (1-1273)(K986P_V987P_Y453F_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23579 - RNA, 4094 nt, Artificial Sequence
  SARS-CoV-2/Wuhan/WIV05/2019__EPI_ISL_402128 spike protein mRNA gc (1-1273)(K986P_V987P_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23580 - RNA, 4094 nt, Artificial Sequence
  SARS-CoV-2/Wuhan/WIV05/2019__EPI_ISL_402128 spike protein mRNA gc (1-1273)(K986P_V987P_D614G_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23581 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23582 - RNA, 4088 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23583 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23584 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23585 - RNA, 4085 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23586 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23587 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23588 - RNA, 4094 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23589 - RNA, 4094 nt, Artificial Sequence; identical to SEQ ID NO: 151
  SARS-CoV-2/Wuhan/WIV05/2019__EPI_ISL_402128 spike protein mRNA gc mod (1-1273)(K986P_V987P) R10162

SEQ ID NO: 23590 - RNA, 4094 nt, Artificial Sequence
  SARS-CoV-2/Wuhan/WIV05/2019__EPI_ISL_402128 spike protein mRNA gc mod (1-1273)(K986P_V987P_ D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23591 - RNA, 4094 nt, Artificial Sequence
  SARS-CoV-2/Wuhan/WIV05/2019__EPI_ISL_402128 spike protein mRNA gc mod (1-1273)(K986P_V987P_A222V_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23592 - RNA, 4094 nt, Artificial Sequence
  SARS-CoV-2/Wuhan/WIV05/2019__EPI_ISL_402128 spike protein mRNA gc mod (1-1273)(K986P_V987P_N439K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23593 - RNA, 4094 nt, Artificial Sequence
  SARS-CoV-2/Wuhan/WIV05/2019__EPI_ISL_402128 spike protein mRNA gc mod (1-1273)(K986P_V987P_S477N_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23594 - RNA, 4094 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23595 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23596 - RNA, 4094 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23597 - RNA, 4094 nt, Artificial Sequence
  SARS-CoV-2/Wuhan/WIV05/2019__EPI_ISL_402128 spike protein mRNA gc mod (1-1273)(K986P_V987P_D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23598 - RNA, 4094 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23599 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23600 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23601 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23602 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23603 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23604 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23605 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23606 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23607 - RNA, 4094 nt, Artificial Sequence
  SARS-CoV-2/Wuhan/WIV05/2019__EPI_ISL_402128 spike protein mRNA gc mod (1-1273)(K986P_V987P)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23608 - RNA, 4094 nt, Artificial Sequence
  SARS-CoV-2/Wuhan/WIV05/2019__EPI_ISL_402128 spike protein mRNA gc mod (1-1273)(K986P_V987P_ D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23609 - RNA, 4094 nt, Artificial Sequence
  SARS-CoV-2/Wuhan/WIV05/2019__EPI_ISL_402128 spike protein mRNA gc mod (1-1273)(K986P_V987P_A222V_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23610 - RNA, 4094 nt, Artificial Sequence
  SARS-CoV-2/Wuhan/WIV05/2019__EPI_ISL_402128 spike protein mRNA gc mod (1-1273)(K986P_V987P_N439K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23611 - RNA, 4094 nt, Artificial Sequence
  SARS-CoV-2/Wuhan/WIV05/2019__EPI_ISL_402128 spike protein mRNA gc mod (1-1273)(K986P_V987P_S477N_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23612 - RNA, 4094 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23613 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23614 - RNA, 4094 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23615 - RNA, 4094 nt, Artificial Sequence
  SARS-CoV-2/Wuhan/WIV05/2019__EPI_ISL_402128 spike protein mRNA gc mod (1-1273)(K986P_V987P_D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23616 - RNA, 4094 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23617 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23618 - RNA, 4088 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23619 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23620 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23621 - RNA, 4085 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagucccgcagucggcguccagcggcucugcuuguucgugugugugucguugcaggccuuauucaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23622 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagucccgcagucggcguccagcggcucugcuuguucgugugugugucguugcaggccuuauucaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23623 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagucccgcagucggcguccagcggcucugcuuguucgugugugugucguugcaggccuuauucaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23624 - RNA, 4094 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagucccgcagucggcguccagcggcucugcuuguucgugugugugucguugcaggccuuauucaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23625 - RNA, 1521 nt, Artificial Sequence
  SARS-CoV-2/Wuhan/WIV05/2019__EPI_ISL_402128 spike protein mRNA gc (1-15,334-528) Ferritin construct
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggggguggaagcggcggggguggaagugacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23626 - RNA, 1119 nt, Artificial Sequence
  SARS-CoV-2/Wuhan/WIV05/2019__EPI_ISL_402128 spike protein mRNA gc (334-528) Foldon construct
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugcccaugggcagccugcagccgcucgccacccuguaccugcucgggaugcugguggccuccguccuggcgaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcagcggcggguacauccccgaggccccgcgcgacggccaggccuacgugcggaaggacggcgaguggguccugcugagcaccuuccucugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23627 - RNA, 1497 nt, Artificial Sequence
  SARS-CoV-2/Wuhan/WIV05/2019__EPI_ISL_402128 spike protein mRNA gc (1-15,334-528) LumSynth construct
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggcggcggcuccggaggcggagguagcgggggacagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23628 - RNA, 1458 nt, Artificial Sequence
  SARS-CoV-2/Wuhan/WIV05/2019__EPI_ISL_402128 spike protein mRNA gc (334-528) LumSynth construct
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcggcgggggcgggagcggcgggggcggcuccgggggcgggaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23629 - RNA, 4191 nt, Artificial Sequence
  SARS-CoV-2/Wuhan/WIV05/2019__EPI_ISL_402128 spike protein mRNA gc (1-1273)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23630 - RNA, 4191 nt, Artificial Sequence
  SARS-CoV-2/Wuhan/WIV05/2019__EPI_ISL_402128 spike protein mRNA gc (1-1273)(D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23631 - RNA, 4191 nt, Artificial Sequence
  SARS-CoV-2/Wuhan/WIV05/2019__EPI_ISL_402128 spike protein mRNA gc (1-1273)(A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23632 - RNA, 4191 nt, Artificial Sequence
  SARS-CoV-2/Wuhan/WIV05/2019__EPI_ISL_402128 spike protein mRNA gc (1-1273)(N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23633 - RNA, 4191 nt, Artificial Sequence
  SARS-CoV-2/Wuhan/WIV05/2019__EPI_ISL_402128 spike protein mRNA gc (1-1273)(S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23634 - RNA, 4191 nt, Artificial Sequence
  SARS-CoV-2/Wuhan/WIV05/2019__EPI_ISL_402128 spike protein mRNA gc (1-1273)(N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23635 - RNA, 4185 nt, Artificial Sequence
  SARS-CoV-2/Wuhan/WIV05/2019__EPI_ISL_402128 spike protein mRNA gc (1-1273)(H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23636 - RNA, 4191 nt, Artificial Sequence
  SARS-CoV-2/Wuhan/WIV05/2019__EPI_ISL_402128 spike protein mRNA gc (1-1273)(Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23637 - RNA, 4191 nt, Artificial Sequence
  SARS-CoV-2/Wuhan/WIV05/2019__EPI_ISL_402128 spike protein mRNA gc (1-1273)(D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23638 - RNA, 4191 nt, Artificial Sequence
  SARS-CoV-2/Wuhan/WIV05/2019__EPI_ISL_402128 spike protein mRNA gc (1-1273)(D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23639 - RNA, 4185 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23640 - RNA, 4185 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23641 - RNA, 4182 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23642 - RNA, 4191 nt, Artificial Sequence
  SARS-CoV-2/Wuhan/WIV05/2019__EPI_ISL_402128 spike protein mRNA gc (1-1273)(K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23643 - RNA, 4182 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23644 - RNA, 4191 nt, Artificial Sequence
  SARS-CoV-2/Wuhan/WIV05/2019__EPI_ISL_402128 spike protein mRNA gc (1-1273)(E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23645 - RNA, 4191 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23646 - RNA, 4191 nt, Artificial Sequence
  SARS-CoV-2/Wuhan/WIV05/2019__EPI_ISL_402128 spike protein mRNA gc (1-1273)(S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23647 - RNA, 4191 nt, Artificial Sequence; identical to SEQ ID NO: 23629
  SARS-CoV-2/Wuhan/WIV05/2019__EPI_ISL_402128 spike protein mRNA gc (1-1273)

SEQ ID NO: 23648 - RNA, 4191 nt, Artificial Sequence
  SARS-CoV-2/Wuhan/WIV05/2019__EPI_ISL_402128 spike protein mRNA gc (1-1273)(D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23649 - RNA, 4191 nt, Artificial Sequence
  SARS-CoV-2/Wuhan/WIV05/2019__EPI_ISL_402128 spike protein mRNA gc (1-1273)(A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23650 - RNA, 4191 nt, Artificial Sequence
  SARS-CoV-2/Wuhan/WIV05/2019__EPI_ISL_402128 spike protein mRNA gc (1-1273)(N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23651 - RNA, 4191 nt, Artificial Sequence
  SARS-CoV-2/Wuhan/WIV05/2019__EPI_ISL_402128 spike protein mRNA gc (1-1273)(S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23652 - RNA, 4191 nt, Artificial Sequence
  SARS-CoV-2/Wuhan/WIV05/2019__EPI_ISL_402128 spike protein mRNA gc (1-1273)(N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23653 - RNA, 4185 nt, Artificial Sequence
  SARS-CoV-2/Wuhan/WIV05/2019__EPI_ISL_402128 spike protein mRNA gc (1-1273)(H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacaagguggaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgccccgcacggggugguguuccuccacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagcccgugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23654 - RNA, 4191 nt, Artificial Sequence
  SARS-CoV-2/Wuhan/WIV05/2019__EPI_ISL_402128 spike protein mRNA gc (1-1273)(Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23655 - RNA, 4191 nt, Artificial Sequence
  SARS-CoV-2/Wuhan/WIV05/2019__EPI_ISL_402128 spike protein mRNA gc (1-1273)(D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23656 - RNA, 4191 nt, Artificial Sequence
  SARS-CoV-2/Wuhan/WIV05/2019__EPI_ISL_402128 spike protein mRNA gc (1-1273)(D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23657 - RNA, 4185 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacaagguggaggccgaggugcagaucgaccggcugaucaccggccgccuccagucccugcagaccuacgucacccagcagcugauccgggccgcggagauccgcgccagcgccaaccucgccgccaccaagaugagcgagugcgugcugggccaguccaagcggguggacuucugcgggaagggcuaccaccugaugagcuucccccaguccgcgccgcacggggucguguuccuccacgucacguacgugcccgcccaggagaagaacuucaccaccgcccccgccaucugccacgacggcaaggcgcacuucccccgcgaggggguguucgucagcaacggcacccacugguucgugacgcagcggaacuucuacgagccgcagaucaucaccaccgacaacaccuucguguccggcaacugcgacgucgugaucgggaucgugaacaacacggucuacgacccccugcagcccgagcuggacagcuucaaggaggagcucgacaaguacuucaagaaccacaccucccccgacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggccgugguacaucuggcugggcuucaucgccgggcugaucgccaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23658 - RNA, 4185 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23659 - RNA, 4182 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacaagguggaggccgagguccagaucgaccggcugaucacgggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucaccuacgugccggcccaggagaagaacuucacgaccgcccccgccaucugccacgacggcaaggcccacuucccccgcgagggggucuucgugagcaacggcacccacugguucgugacccagcggaacuucuacgagccccagaucaucacgacccacaacaccuucgucuccggcaacugcgacguggugaucgggaucgucaacaacaccguguacgacccgcugcagcccgagcuggacagcuucaaggaggagcucgacaaguacuucaagaaccacacgucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23660 - RNA, 4191 nt, Artificial Sequence
  SARS-CoV-2/Wuhan/WIV05/2019__EPI_ISL_402128 spike protein mRNA gc (1-1273)(K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23661 - RNA, 4182 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacaagguggaggccgaggugcagaucgaccgccugaucaccggccggcuccagagccugcagaccuacgucacccagcagcugauccgcgccgcggagauccgggccagcgccaaccucgccgccaccaagauguccgagugcgugcuggggcagagcaagcgcguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgggagggcguguucgucuccaacggcacccacugguucgugacgcagcgcaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccggcugaacgagguggccaagaaccucaacgagucccugaucgaccugcaggagcucggcaaguacgagcaguacaucaaguggccgugguacaucuggcugggguucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23662 - RNA, 4191 nt, Artificial Sequence
  SARS-CoV-2/Wuhan/WIV05/2019__EPI_ISL_402128 spike protein mRNA gc (1-1273)(E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23663 - RNA, 4191 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaucaagauguccgagugcguccucggccagagcaagcgcguggacuucugcgggaagggcuaccaccugauguccuucccccagagcgcgccccacgggguggucuuccugcacgugaccuacgucccggcccaggagaagaacuucacgaccgcccccgccaucugccacgacggcaaggcccacuucccccgggaggggguguucguguccaacggcacccacugguucgucacccagcgcaacuucuacgagccccagaucaucacgaccgacaacaccuucgugagcggcaacugcgacguggucaucgggaucgugaacaacaccguguacgacccgcuccagcccgagcuggacuccuucaaggaggagcuggacaaguacuucaagaaccacacgagccccgacgucgaccucggcgacaucuccgggaucaacgccagcguggugaacauccagaaggagaucgaccggcugaacgaggucgccaagaaccugaacgagucccucaucgaccugcaggagcugggcaaguacgagcaguacaucaaguggcccugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagccgguccugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23664 - RNA, 4191 nt, Artificial Sequence
  SARS-CoV-2/Wuhan/WIV05/2019__EPI_ISL_402128 spike protein mRNA gc (1-1273)(S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaccaagaugagcgagugcguccucggccaguccaagcgcguggacuucugcgggaagggcuaccaccugaugagcuucccccaguccgccccgcacgggguggucuuccugcacgugacguacguccccgcccaggagaagaacuucaccaccgcccccgcgaucugccacgacggcaaggcccacuucccccgggaggggguguucgugagcaacggcacccacugguucgucacgcagcgcaacuucuacgagccgcagaucaucaccaccgacaacaccuucguguccggcaacugcgacguggucaucgggaucgugaacaacacgguguacgacccccuccagcccgagcuggacagcuucaaggaggagcuggacaaguacuucaagaaccacaccucccccgacgucgaccucggcgacaucagcgggaucaacgccuccguggugaacauccagaaggagaucgaccggcugaacgaggucgccaagaaccugaacgagagccucaucgaccugcaggagcugggcaaguacgagcaguacaucaaguggccgugguacaucuggcucggcuucaucgccgggcugaucgcgaucgugauggugaccaucaugcugugcugcaugaccuccugcugcagcugccucaagggcugcugcuccugcgggagcugcugcaaguucgacgaggacgacuccgagcccguccugaagggcgugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23665 - RNA, 4191 nt, Artificial Sequence
  SARS-CoV-2/Wuhan/WIV05/2019__EPI_ISL_402128 spike protein mRNA gc (1-1273)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23666 - RNA, 4191 nt, Artificial Sequence
  SARS-CoV-2/Wuhan/WIV05/2019__EPI_ISL_402128 spike protein mRNA gc (1-1273)(D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23667 - RNA, 4191 nt, Artificial Sequence
  SARS-CoV-2/Wuhan/WIV05/2019__EPI_ISL_402128 spike protein mRNA gc (1-1273)(A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23668 - RNA, 4191 nt, Artificial Sequence
  SARS-CoV-2/Wuhan/WIV05/2019__EPI_ISL_402128 spike protein mRNA gc (1-1273)(N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23669 - RNA, 4191 nt, Artificial Sequence
  SARS-CoV-2/Wuhan/WIV05/2019__EPI_ISL_402128 spike protein mRNA gc (1-1273)(S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23670 - RNA, 4191 nt, Artificial Sequence
  SARS-CoV-2/Wuhan/WIV05/2019__EPI_ISL_402128 spike protein mRNA gc (1-1273)(N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23671 - RNA, 4185 nt, Artificial Sequence
  SARS-CoV-2/Wuhan/WIV05/2019__EPI_ISL_402128 spike protein mRNA gc (1-1273)(H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23672 - RNA, 4191 nt, Artificial Sequence
  SARS-CoV-2/Wuhan/WIV05/2019__EPI_ISL_402128 spike protein mRNA gc (1-1273)(Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23673 - RNA, 4191 nt, Artificial Sequence
  SARS-CoV-2/Wuhan/WIV05/2019__EPI_ISL_402128 spike protein mRNA gc (1-1273)(D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23674 - RNA, 4191 nt, Artificial Sequence
  SARS-CoV-2/Wuhan/WIV05/2019__EPI_ISL_402128 spike protein mRNA gc (1-1273)(D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23675 - RNA, 4185 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23676 - RNA, 4185 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23677 - RNA, 4182 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23678 - RNA, 4191 nt, Artificial Sequence
  SARS-CoV-2/Wuhan/WIV05/2019__EPI_ISL_402128 spike protein mRNA gc (1-1273)(K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23679 - RNA, 4182 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23680 - RNA, 4191 nt, Artificial Sequence
  SARS-CoV-2/Wuhan/WIV05/2019__EPI_ISL_402128 spike protein mRNA gc (1-1273)(E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23681 - RNA, 4191 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23682 - RNA, 4191 nt, Artificial Sequence
  SARS-CoV-2/Wuhan/WIV05/2019__EPI_ISL_402128 spike protein mRNA gc (1-1273)(S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23683 - RNA, 4191 nt, Artificial Sequence
  SARS-CoV-2/Wuhan/WIV05/2019__EPI_ISL_402128 spike protein mRNA gc (1-1273)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23684 - RNA, 4191 nt, Artificial Sequence
  SARS-CoV-2/Wuhan/WIV05/2019__EPI_ISL_402128 spike protein mRNA gc (1-1273)(D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23685 - RNA, 4191 nt, Artificial Sequence
  SARS-CoV-2/Wuhan/WIV05/2019__EPI_ISL_402128 spike protein mRNA gc (1-1273)(A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23686 - RNA, 4191 nt, Artificial Sequence
  SARS-CoV-2/Wuhan/WIV05/2019__EPI_ISL_402128 spike protein mRNA gc (1-1273)(N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23687 - RNA, 4191 nt, Artificial Sequence
  SARS-CoV-2/Wuhan/WIV05/2019__EPI_ISL_402128 spike protein mRNA gc (1-1273)(S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23688 - RNA, 4191 nt, Artificial Sequence
  SARS-CoV-2/Wuhan/WIV05/2019__EPI_ISL_402128 spike protein mRNA gc (1-1273)(N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23689 - RNA, 4185 nt, Artificial Sequence
  SARS-CoV-2/Wuhan/WIV05/2019__EPI_ISL_402128 spike protein mRNA gc (1-1273)(H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgugacauacguccccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23690 - RNA, 4191 nt, Artificial Sequence
  SARS-CoV-2/Wuhan/WIV05/2019__EPI_ISL_402128 spike protein mRNA gc (1-1273)(Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23691 - RNA, 4191 nt, Artificial Sequence
  SARS-CoV-2/Wuhan/WIV05/2019__EPI_ISL_402128 spike protein mRNA gc (1-1273)(D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23692 - RNA, 4191 nt, Artificial Sequence
  SARS-CoV-2/Wuhan/WIV05/2019__EPI_ISL_402128 spike protein mRNA gc (1-1273)(D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23693 - RNA, 4185 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgccccacacggcguggucuuccuccacgugacauacgugcccgcccaggagaagaacuucaccaccgcccccgccaucugccacgacggcaaggcccacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23694 - RNA, 4185 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23695 - RNA, 4182 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacaagguggaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgucccagcccaggagaagaacuucacaaccgcccccgccaucugccacgacggcaaggcccacuucccccgggagggaguguucgugagcaacggcacccacugguucgugacccagcggaacuucuacgagccccagaucaucaccacccacaacaccuucgugagcggcaacugcgacguggugaucggcaucgugaacaacaccguguacgacccccugcagcccgagcuggacagcuucaaggaggagcuggacaaguacuucaagaaccacaccagcccugacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23696 - RNA, 4191 nt, Artificial Sequence
  SARS-CoV-2/Wuhan/WIV05/2019__EPI_ISL_402128 spike protein mRNA gc (1-1273)(K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23697 - RNA, 4182 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggacaagguggaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgccccacacggcguggucuuccugcacgugacauacgugcccgcccaggagaagaacuucaccaccgcccccgccaucugccacgacggaaaggcccacuucccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcucgacaaguacuucaagaaccacaccagccccgacguggaccugggcgacaucagcggcaucaacgcuagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23698 - RNA, 4191 nt, Artificial Sequence
  SARS-CoV-2/Wuhan/WIV05/2019__EPI_ISL_402128 spike protein mRNA gc (1-1273)(E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23699 - RNA, 4191 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacaagguggaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgucaccuacgugccagcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccugacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23700 - RNA, 4191 nt, Artificial Sequence
  SARS-CoV-2/Wuhan/WIV05/2019__EPI_ISL_402128 spike protein mRNA gc (1-1273)(S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggacaagguggaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgccccacacggcgugguguuccugcacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagccagugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23701 - RNA, 4191 nt, Artificial Sequence
  SARS-CoV-2/Wuhan/WIV05/2019__EPI_ISL_402128 spike protein mRNA gc mod (1-1273)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23702 - RNA, 4191 nt, Artificial Sequence
  SARS-CoV-2/Wuhan/WIV05/2019__EPI_ISL_402128 spike protein mRNA gc mod (1-1273)(D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23703 - RNA, 4191 nt, Artificial Sequence
  SARS-CoV-2/Wuhan/WIV05/2019__EPI_ISL_402128 spike protein mRNA gc mod (1-1273)(A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23704 - RNA, 4191 nt, Artificial Sequence
  SARS-CoV-2/Wuhan/WIV05/2019__EPI_ISL_402128 spike protein mRNA gc mod (1-1273)(N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23705 - RNA, 4191 nt, Artificial Sequence
  SARS-CoV-2/Wuhan/WIV05/2019__EPI_ISL_402128 spike protein mRNA gc mod (1-1273)(S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23706 - RNA, 4191 nt, Artificial Sequence
  SARS-CoV-2/Wuhan/WIV05/2019__EPI_ISL_402128 spike protein mRNA gc mod (1-1273)(N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23707 - RNA, 4185 nt, Artificial Sequence
  SARS-CoV-2/Wuhan/WIV05/2019__EPI_ISL_402128 spike protein mRNA gc mod (1-1273)(H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23708 - RNA, 4191 nt, Artificial Sequence
  SARS-CoV-2/Wuhan/WIV05/2019__EPI_ISL_402128 spike protein mRNA gc mod (1-1273)(Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23709 - RNA, 4191 nt, Artificial Sequence
  SARS-CoV-2/Wuhan/WIV05/2019__EPI_ISL_402128 spike protein mRNA gc mod (1-1273)(D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23710 - RNA, 4191 nt, Artificial Sequence
  SARS-CoV-2/Wuhan/WIV05/2019__EPI_ISL_402128 spike protein mRNA gc mod (1-1273)(D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23711 - RNA, 4185 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23712 - RNA, 4185 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23713 - RNA, 4182 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23714 - RNA, 4191 nt, Artificial Sequence
  SARS-CoV-2/Wuhan/WIV05/2019__EPI_ISL_402128 spike protein mRNA gc mod (1-1273)(K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23715 - RNA, 4182 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23716 - RNA, 4191 nt, Artificial Sequence
  SARS-CoV-2/Wuhan/WIV05/2019__EPI_ISL_402128 spike protein mRNA gc mod (1-1273)(E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23717 - RNA, 4191 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23718 - RNA, 4191 nt, Artificial Sequence
  SARS-CoV-2/Wuhan/WIV05/2019__EPI_ISL_402128 spike protein mRNA gc mod (1-1273)(S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23719 - RNA, 4191 nt, Artificial Sequence
  SARS-CoV-2/Wuhan/WIV05/2019__EPI_ISL_402128 spike protein mRNA gc mod (1-1273)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23720 - RNA, 4191 nt, Artificial Sequence
  SARS-CoV-2/Wuhan/WIV05/2019__EPI_ISL_402128 spike protein mRNA gc mod (1-1273)(D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23721 - RNA, 4191 nt, Artificial Sequence
  SARS-CoV-2/Wuhan/WIV05/2019__EPI_ISL_402128 spike protein mRNA gc mod (1-1273)(A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23722 - RNA, 4191 nt, Artificial Sequence
  SARS-CoV-2/Wuhan/WIV05/2019__EPI_ISL_402128 spike protein mRNA gc mod (1-1273)(N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23723 - RNA, 4191 nt, Artificial Sequence
  SARS-CoV-2/Wuhan/WIV05/2019__EPI_ISL_402128 spike protein mRNA gc mod (1-1273)(S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23724 - RNA, 4191 nt, Artificial Sequence
  SARS-CoV-2/Wuhan/WIV05/2019__EPI_ISL_402128 spike protein mRNA gc mod (1-1273)(N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23725 - RNA, 4185 nt, Artificial Sequence
  SARS-CoV-2/Wuhan/WIV05/2019__EPI_ISL_402128 spike protein mRNA gc mod (1-1273)(H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23726 - RNA, 4191 nt, Artificial Sequence
  SARS-CoV-2/Wuhan/WIV05/2019__EPI_ISL_402128 spike protein mRNA gc mod (1-1273)(Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23727 - RNA, 4191 nt, Artificial Sequence
  SARS-CoV-2/Wuhan/WIV05/2019__EPI_ISL_402128 spike protein mRNA gc mod (1-1273)(D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23728 - RNA, 4191 nt, Artificial Sequence
  SARS-CoV-2/Wuhan/WIV05/2019__EPI_ISL_402128 spike protein mRNA gc mod (1-1273)(D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23729 - RNA, 4185 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23730 - RNA, 4185 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23731 - RNA, 4182 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23732 - RNA, 4191 nt, Artificial Sequence
  SARS-CoV-2/Wuhan/WIV05/2019__EPI_ISL_402128 spike protein mRNA gc mod (1-1273)(K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23733 - RNA, 4182 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23734 - RNA, 4191 nt, Artificial Sequence
  SARS-CoV-2/Wuhan/WIV05/2019__EPI_ISL_402128 spike protein mRNA gc mod (1-1273)(E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23735 - RNA, 4191 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23736 - RNA, 4191 nt, Artificial Sequence
  SARS-CoV-2/Wuhan/WIV05/2019__EPI_ISL_402128 spike protein mRNA gc mod (1-1273)(S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23737 - RNA, 4191 nt, Artificial Sequence
  SARS-CoV-2/Wuhan/WIV05/2019__EPI_ISL_402128 spike protein mRNA gc (1-1273)(K986P_V987P) R10183
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23738 - RNA, 4191 nt, Artificial Sequence
  SARS-CoV-2/Wuhan/WIV05/2019__EPI_ISL_402128 spike protein mRNA gc (1-1273)(K986P_V987P_ D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23739 - RNA, 4191 nt, Artificial Sequence
  SARS-CoV-2/Wuhan/WIV05/2019__EPI_ISL_402128 spike protein mRNA gc (1-1273)(K986P_V987P_A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23740 - RNA, 4191 nt, Artificial Sequence
  SARS-CoV-2/Wuhan/WIV05/2019__EPI_ISL_402128 spike protein mRNA gc (1-1273)(K986P_V987P_N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23741 - RNA, 4191 nt, Artificial Sequence
  SARS-CoV-2/Wuhan/WIV05/2019__EPI_ISL_402128 spike protein mRNA gc (1-1273)(K986P_V987P_S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23742 - RNA, 4191 nt, Artificial Sequence
  SARS-CoV-2/Wuhan/WIV05/2019__EPI_ISL_402128 spike protein mRNA gc (1-1273)(K986P_V987P_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23743 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23744 - RNA, 4191 nt, Artificial Sequence
  SARS-CoV-2/Wuhan/WIV05/2019__EPI_ISL_402128 spike protein mRNA gc (1-1273)(K986P_V987P_Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23745 - RNA, 4191 nt, Artificial Sequence
  SARS-CoV-2/Wuhan/WIV05/2019__EPI_ISL_402128 spike protein mRNA gc (1-1273)(K986P_V987P_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23746 - RNA, 4191 nt, Artificial Sequence
  SARS-CoV-2/Wuhan/WIV05/2019__EPI_ISL_402128 spike protein mRNA gc (1-1273)(K986P_V987P_D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23747 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23748 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23749 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23750 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23751 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23752 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23753 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23754 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23755 - RNA, 4191 nt, Artificial Sequence
  SARS-CoV-2/Wuhan/WIV05/2019__EPI_ISL_402128 spike protein mRNA gc (1-1273)(K986P_V987P)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23756 - RNA, 4191 nt, Artificial Sequence
  SARS-CoV-2/Wuhan/WIV05/2019__EPI_ISL_402128 spike protein mRNA gc (1-1273)(K986P_V987P_ D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23757 - RNA, 4191 nt, Artificial Sequence
  SARS-CoV-2/Wuhan/WIV05/2019__EPI_ISL_402128 spike protein mRNA gc (1-1273)(K986P_V987P_A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23758 - RNA, 4191 nt, Artificial Sequence
  SARS-CoV-2/Wuhan/WIV05/2019__EPI_ISL_402128 spike protein mRNA gc (1-1273)(K986P_V987P_N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23759 - RNA, 4191 nt, Artificial Sequence
  SARS-CoV-2/Wuhan/WIV05/2019__EPI_ISL_402128 spike protein mRNA gc (1-1273)(K986P_V987P_S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23760 - RNA, 4191 nt, Artificial Sequence
  SARS-CoV-2/Wuhan/WIV05/2019__EPI_ISL_402128 spike protein mRNA gc (1-1273)(K986P_V987P_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23761 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23762 - RNA, 4191 nt, Artificial Sequence
  SARS-CoV-2/Wuhan/WIV05/2019__EPI_ISL_402128 spike protein mRNA gc (1-1273)(K986P_V987P_Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23763 - RNA, 4191 nt, Artificial Sequence
  SARS-CoV-2/Wuhan/WIV05/2019__EPI_ISL_402128 spike protein mRNA gc (1-1273)(K986P_V987P_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23764 - RNA, 4191 nt, Artificial Sequence
  SARS-CoV-2/Wuhan/WIV05/2019__EPI_ISL_402128 spike protein mRNA gc (1-1273)(K986P_V987P_D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23765 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23766 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23767 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23768 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23769 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23770 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23771 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23772 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23773 - RNA, 4191 nt, Artificial Sequence
  SARS-CoV-2/Wuhan/WIV05/2019__EPI_ISL_402128 spike protein mRNA gc (1-1273)(K986P_V987P)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23774 - RNA, 4191 nt, Artificial Sequence
  SARS-CoV-2/Wuhan/WIV05/2019__EPI_ISL_402128 spike protein mRNA gc (1-1273)(K986P_V987P_ D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23775 - RNA, 4191 nt, Artificial Sequence
  SARS-CoV-2/Wuhan/WIV05/2019__EPI_ISL_402128 spike protein mRNA gc (1-1273)(K986P_V987P_A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23776 - RNA, 4191 nt, Artificial Sequence
  SARS-CoV-2/Wuhan/WIV05/2019__EPI_ISL_402128 spike protein mRNA gc (1-1273)(K986P_V987P_N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23777 - RNA, 4191 nt, Artificial Sequence
  SARS-CoV-2/Wuhan/WIV05/2019__EPI_ISL_402128 spike protein mRNA gc (1-1273)(K986P_V987P_S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23778 - RNA, 4191 nt, Artificial Sequence
  SARS-CoV-2/Wuhan/WIV05/2019__EPI_ISL_402128 spike protein mRNA gc (1-1273)(K986P_V987P_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23779 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23780 - RNA, 4191 nt, Artificial Sequence
  SARS-CoV-2/Wuhan/WIV05/2019__EPI_ISL_402128 spike protein mRNA gc (1-1273)(K986P_V987P_Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23781 - RNA, 4191 nt, Artificial Sequence
  SARS-CoV-2/Wuhan/WIV05/2019__EPI_ISL_402128 spike protein mRNA gc (1-1273)(K986P_V987P_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23782 - RNA, 4191 nt, Artificial Sequence
  SARS-CoV-2/Wuhan/WIV05/2019__EPI_ISL_402128 spike protein mRNA gc (1-1273)(K986P_V987P_D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23783 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23784 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23785 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23786 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23787 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23788 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23789 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23790 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23791 - RNA, 4191 nt, Artificial Sequence
  SARS-CoV-2/Wuhan/WIV05/2019__EPI_ISL_402128 spike protein mRNA gc (1-1273)(K986P_V987P)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23792 - RNA, 4191 nt, Artificial Sequence
  SARS-CoV-2/Wuhan/WIV05/2019__EPI_ISL_402128 spike protein mRNA gc (1-1273)(K986P_V987P_ D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23793 - RNA, 4191 nt, Artificial Sequence
  SARS-CoV-2/Wuhan/WIV05/2019__EPI_ISL_402128 spike protein mRNA gc (1-1273)(K986P_V987P_A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23794 - RNA, 4191 nt, Artificial Sequence
  SARS-CoV-2/Wuhan/WIV05/2019__EPI_ISL_402128 spike protein mRNA gc (1-1273)(K986P_V987P_N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23795 - RNA, 4191 nt, Artificial Sequence
  SARS-CoV-2/Wuhan/WIV05/2019__EPI_ISL_402128 spike protein mRNA gc (1-1273)(K986P_V987P_S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23796 - RNA, 4191 nt, Artificial Sequence
  SARS-CoV-2/Wuhan/WIV05/2019__EPI_ISL_402128 spike protein mRNA gc (1-1273)(K986P_V987P_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23797 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23798 - RNA, 4191 nt, Artificial Sequence
  SARS-CoV-2/Wuhan/WIV05/2019__EPI_ISL_402128 spike protein mRNA gc (1-1273)(K986P_V987P_Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23799 - RNA, 4191 nt, Artificial Sequence
  SARS-CoV-2/Wuhan/WIV05/2019__EPI_ISL_402128 spike protein mRNA gc (1-1273)(K986P_V987P_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23800 - RNA, 4191 nt, Artificial Sequence
  SARS-CoV-2/Wuhan/WIV05/2019__EPI_ISL_402128 spike protein mRNA gc (1-1273)(K986P_V987P_D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23801 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23802 - RNA, 4185 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23803 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23804 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23805 - RNA, 4182 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23806 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23807 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23808 - RNA, 4191 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23809 - RNA, 4191 nt, Artificial Sequence
  SARS-CoV-2/Wuhan/WIV05/2019__EPI_ISL_402128 spike protein mRNA gc mod (1-1273)(K986P_V987P)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23810 - RNA, 4191 nt, Artificial Sequence
  SARS-CoV-2/Wuhan/WIV05/2019__EPI_ISL_402128 spike protein mRNA gc mod (1-1273)(K986P_V987P_ D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23811 - RNA, 4191 nt, Artificial Sequence
  SARS-CoV-2/Wuhan/WIV05/2019__EPI_ISL_402128 spike protein mRNA gc mod (1-1273)(K986P_V987P_A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23812 - RNA, 4191 nt, Artificial Sequence
  SARS-CoV-2/Wuhan/WIV05/2019__EPI_ISL_402128 spike protein mRNA gc mod (1-1273)(K986P_V987P_N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23813 - RNA, 4191 nt, Artificial Sequence
  SARS-CoV-2/Wuhan/WIV05/2019__EPI_ISL_402128 spike protein mRNA gc mod (1-1273)(K986P_V987P_S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23814 - RNA, 4191 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23815 - RNA, 4185 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23816 - RNA, 4191 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23817 - RNA, 4191 nt, Artificial Sequence
  SARS-CoV-2/Wuhan/WIV05/2019__EPI_ISL_402128 spike protein mRNA gc mod (1-1273)(K986P_V987P_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23818 - RNA, 4191 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23819 - RNA, 4185 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23820 - RNA, 4185 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23821 - RNA, 4182 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23822 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23823 - RNA, 4182 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23824 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23825 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23826 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23827 - RNA, 4191 nt, Artificial Sequence
  SARS-CoV-2/Wuhan/WIV05/2019__EPI_ISL_402128 spike protein mRNA gc mod (1-1273)(K986P_V987P)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23828 - RNA, 4191 nt, Artificial Sequence
  SARS-CoV-2/Wuhan/WIV05/2019__EPI_ISL_402128 spike protein mRNA gc mod (1-1273)(K986P_V987P_ D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23829 - RNA, 4191 nt, Artificial Sequence
  SARS-CoV-2/Wuhan/WIV05/2019__EPI_ISL_402128 spike protein mRNA gc mod (1-1273)(K986P_V987P_A222V_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23830 - RNA, 4191 nt, Artificial Sequence
  SARS-CoV-2/Wuhan/WIV05/2019__EPI_ISL_402128 spike protein mRNA gc mod (1-1273)(K986P_V987P_N439K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23831 - RNA, 4191 nt, Artificial Sequence
  SARS-CoV-2/Wuhan/WIV05/2019__EPI_ISL_402128 spike protein mRNA gc mod (1-1273)(K986P_V987P_S477N_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23832 - RNA, 4191 nt, Artificial Sequence
  SARS-CoV-2/Wuhan/WIV05/2019__EPI_ISL_402128 spike protein mRNA gc mod (1-1273)(K986P_V987P_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23833 - RNA, 4185 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23834 - RNA, 4191 nt, Artificial Sequence
  SARS-CoV-2/Wuhan/WIV05/2019__EPI_ISL_402128 spike protein mRNA gc mod (1-1273)(K986P_V987P_Y453F_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23835 - RNA, 4191 nt, Artificial Sequence
  SARS-CoV-2/Wuhan/WIV05/2019__EPI_ISL_402128 spike protein mRNA gc mod (1-1273)(K986P_V987P_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23836 - RNA, 4191 nt, Artificial Sequence
  SARS-CoV-2/Wuhan/WIV05/2019__EPI_ISL_402128 spike protein mRNA gc mod (1-1273)(K986P_V987P_D614G_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23837 - RNA, 4185 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23838 - RNA, 4185 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23839 - RNA, 4182 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23840 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23841 - RNA, 4182 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23842 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23843 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23844 - RNA, 4191 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23845 - RNA, 1459 nt, Artificial Sequence
  SARS-CoV-2/Wuhan/WIV05/2019__EPI_ISL_402128 spike protein mRNA gc (1-15,334-528) Ferritin construct
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggggguggaagcggcggggguggaagugacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23846 - RNA, 1057 nt, Artificial Sequence
  SARS-CoV-2/Wuhan/WIV05/2019__EPI_ISL_402128 spike protein mRNA gc (334-528) Foldon construct
aggagacccgugacccggaaguuguacggcuacgcgacuuucccucccacaaacccucgcgcccuuccuuuccuacuugggcccggcagaaagcuuaccaugcccaugggcagccugcagccgcucgccacccuguaccugcucgggaugcugguggccuccguccuggcgaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcagcggcggguacauccccgaggccccgcgcgacggccaggccuacgugcggaaggacggcgaguggguccugcugagcaccuuccucugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23847 - RNA, 1435 nt, Artificial Sequence
  SARS-CoV-2/Wuhan/WIV05/2019__EPI_ISL_402128 spike protein mRNA gc (1-15,334-528) LumSynth construct
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggcggcggcuccggaggcggagguagcgggggacagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23848 - RNA, 1396 nt, Artificial Sequence
  SARS-CoV-2/Wuhan/WIV05/2019__EPI_ISL_402128 spike protein mRNA gc (334-528) LumSynth construct
aggagacccgugacccggaaguuguacggcuacgcgacuuucccucccacaaacccucgcgcccuuccuuuccuacuugggcccggcagaaagcuuaccaugcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcggcgggggcgggagcggcgggggcggcuccgggggcgggaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23849 - RNA, 4129 nt, Artificial Sequence
  SARS-CoV-2/Wuhan/WIV05/2019__EPI_ISL_402128 spike protein mRNA gc (1-1273)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23850 - RNA, 4129 nt, Artificial Sequence
  SARS-CoV-2/Wuhan/WIV05/2019__EPI_ISL_402128 spike protein mRNA gc (1-1273)(D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23851 - RNA, 4129 nt, Artificial Sequence
  SARS-CoV-2/Wuhan/WIV05/2019__EPI_ISL_402128 spike protein mRNA gc (1-1273)(A222V_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23852 - RNA, 4129 nt, Artificial Sequence
  SARS-CoV-2/Wuhan/WIV05/2019__EPI_ISL_402128 spike protein mRNA gc (1-1273)(N439K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23853 - RNA, 4129 nt, Artificial Sequence
  SARS-CoV-2/Wuhan/WIV05/2019__EPI_ISL_402128 spike protein mRNA gc (1-1273)(S477N_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23854 - RNA, 4129 nt, Artificial Sequence
  SARS-CoV-2/Wuhan/WIV05/2019__EPI_ISL_402128 spike protein mRNA gc (1-1273)(N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23855 - RNA, 4123 nt, Artificial Sequence
  SARS-CoV-2/Wuhan/WIV05/2019__EPI_ISL_402128 spike protein mRNA gc (1-1273)(H69del_V70del_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23856 - RNA, 4129 nt, Artificial Sequence
  SARS-CoV-2/Wuhan/WIV05/2019__EPI_ISL_402128 spike protein mRNA gc (1-1273)(Y453F_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23857 - RNA, 4129 nt, Artificial Sequence
  SARS-CoV-2/Wuhan/WIV05/2019__EPI_ISL_402128 spike protein mRNA gc (1-1273)(D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23858 - RNA, 4129 nt, Artificial Sequence
  SARS-CoV-2/Wuhan/WIV05/2019__EPI_ISL_402128 spike protein mRNA gc (1-1273)(D614G_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23859 - RNA, 4123 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23860 - RNA, 4123 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23861 - RNA, 4120 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23862 - RNA, 4129 nt, Artificial Sequence
  SARS-CoV-2/Wuhan/WIV05/2019__EPI_ISL_402128 spike protein mRNA gc (1-1273)(K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23863 - RNA, 4120 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23864 - RNA, 4129 nt, Artificial Sequence
  SARS-CoV-2/Wuhan/WIV05/2019__EPI_ISL_402128 spike protein mRNA gc (1-1273)(E484K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23865 - RNA, 4129 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23866 - RNA, 4129 nt, Artificial Sequence
  SARS-CoV-2/Wuhan/WIV05/2019__EPI_ISL_402128 spike protein mRNA gc (1-1273)(S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23867 - RNA, 4129 nt, Artificial Sequence; identical to SEQ ID NO: 23849
  SARS-CoV-2/Wuhan/WIV05/2019__EPI_ISL_402128 spike protein mRNA gc (1-1273)

SEQ ID NO: 23868 - RNA, 4129 nt, Artificial Sequence
  SARS-CoV-2/Wuhan/WIV05/2019__EPI_ISL_402128 spike protein mRNA gc (1-1273)(D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23869 - RNA, 4129 nt, Artificial Sequence
  SARS-CoV-2/Wuhan/WIV05/2019__EPI_ISL_402128 spike protein mRNA gc (1-1273)(A222V_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23870 - RNA, 4129 nt, Artificial Sequence
  SARS-CoV-2/Wuhan/WIV05/2019__EPI_ISL_402128 spike protein mRNA gc (1-1273)(N439K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23871 - RNA, 4129 nt, Artificial Sequence
  SARS-CoV-2/Wuhan/WIV05/2019__EPI_ISL_402128 spike protein mRNA gc (1-1273)(S477N_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23872 - RNA, 4129 nt, Artificial Sequence
  SARS-CoV-2/Wuhan/WIV05/2019__EPI_ISL_402128 spike protein mRNA gc (1-1273)(N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23873 - RNA, 4123 nt, Artificial Sequence
  SARS-CoV-2/Wuhan/WIV05/2019__EPI_ISL_402128 spike protein mRNA gc (1-1273)(H69del_V70del_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacaagguggaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgccccgcacggggugguguuccuccacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagcccgugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23874 - RNA, 4129 nt, Artificial Sequence
  SARS-CoV-2/Wuhan/WIV05/2019__EPI_ISL_402128 spike protein mRNA gc (1-1273)(Y453F_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23875 - RNA, 4129 nt, Artificial Sequence
  SARS-CoV-2/Wuhan/WIV05/2019__EPI_ISL_402128 spike protein mRNA gc (1-1273)(D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23876 - RNA, 4129 nt, Artificial Sequence
  SARS-CoV-2/Wuhan/WIV05/2019__EPI_ISL_402128 spike protein mRNA gc (1-1273)(D614G_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23877 - RNA, 4123 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacaagguggaggccgaggugcagaucgaccggcugaucaccggccgccuccagucccugcagaccuacgucacccagcagcugauccgggccgcggagauccgcgccagcgccaaccucgccgccaccaagaugagcgagugcgugcugggccaguccaagcggguggacuucugcgggaagggcuaccaccugaugagcuucccccaguccgcgccgcacggggucguguuccuccacgucacguacgugcccgcccaggagaagaacuucaccaccgcccccgccaucugccacgacggcaaggcgcacuucccccgcgaggggguguucgucagcaacggcacccacugguucgugacgcagcggaacuucuacgagccgcagaucaucaccaccgacaacaccuucguguccggcaacugcgacgucgugaucgggaucgugaacaacacggucuacgacccccugcagcccgagcuggacagcuucaaggaggagcucgacaaguacuucaagaaccacaccucccccgacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggccgugguacaucuggcugggcuucaucgccgggcugaucgccaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23878 - RNA, 4123 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23879 - RNA, 4120 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacaagguggaggccgagguccagaucgaccggcugaucacgggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucaccuacgugccggcccaggagaagaacuucacgaccgcccccgccaucugccacgacggcaaggcccacuucccccgcgagggggucuucgugagcaacggcacccacugguucgugacccagcggaacuucuacgagccccagaucaucacgacccacaacaccuucgucuccggcaacugcgacguggugaucgggaucgucaacaacaccguguacgacccgcugcagcccgagcuggacagcuucaaggaggagcucgacaaguacuucaagaaccacacgucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23880 - RNA, 4129 nt, Artificial Sequence
  SARS-CoV-2/Wuhan/WIV05/2019__EPI_ISL_402128 spike protein mRNA gc (1-1273)(K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23881 - RNA, 4120 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacaagguggaggccgaggugcagaucgaccgccugaucaccggccggcuccagagccugcagaccuacgucacccagcagcugauccgcgccgcggagauccgggccagcgccaaccucgccgccaccaagauguccgagugcgugcuggggcagagcaagcgcguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgggagggcguguucgucuccaacggcacccacugguucgugacgcagcgcaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccggcugaacgagguggccaagaaccucaacgagucccugaucgaccugcaggagcucggcaaguacgagcaguacaucaaguggccgugguacaucuggcugggguucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23882 - RNA, 4129 nt, Artificial Sequence
  SARS-CoV-2/Wuhan/WIV05/2019__EPI_ISL_402128 spike protein mRNA gc (1-1273)(E484K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23883 - RNA, 4129 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaucaagauguccgagugcguccucggccagagcaagcgcguggacuucugcgggaagggcuaccaccugauguccuucccccagagcgcgccccacgggguggucuuccugcacgugaccuacgucccggcccaggagaagaacuucacgaccgcccccgccaucugccacgacggcaaggcccacuucccccgggaggggguguucguguccaacggcacccacugguucgucacccagcgcaacuucuacgagccccagaucaucacgaccgacaacaccuucgugagcggcaacugcgacguggucaucgggaucgugaacaacaccguguacgacccgcuccagcccgagcuggacuccuucaaggaggagcuggacaaguacuucaagaaccacacgagccccgacgucgaccucggcgacaucuccgggaucaacgccagcguggugaacauccagaaggagaucgaccggcugaacgaggucgccaagaaccugaacgagucccucaucgaccugcaggagcugggcaaguacgagcaguacaucaaguggcccugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagccgguccugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23884 - RNA, 4129 nt, Artificial Sequence
  SARS-CoV-2/Wuhan/WIV05/2019__EPI_ISL_402128 spike protein mRNA gc (1-1273)(S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaccaagaugagcgagugcguccucggccaguccaagcgcguggacuucugcgggaagggcuaccaccugaugagcuucccccaguccgccccgcacgggguggucuuccugcacgugacguacguccccgcccaggagaagaacuucaccaccgcccccgcgaucugccacgacggcaaggcccacuucccccgggaggggguguucgugagcaacggcacccacugguucgucacgcagcgcaacuucuacgagccgcagaucaucaccaccgacaacaccuucguguccggcaacugcgacguggucaucgggaucgugaacaacacgguguacgacccccuccagcccgagcuggacagcuucaaggaggagcuggacaaguacuucaagaaccacaccucccccgacgucgaccucggcgacaucagcgggaucaacgccuccguggugaacauccagaaggagaucgaccggcugaacgaggucgccaagaaccugaacgagagccucaucgaccugcaggagcugggcaaguacgagcaguacaucaaguggccgugguacaucuggcucggcuucaucgccgggcugaucgcgaucgugauggugaccaucaugcugugcugcaugaccuccugcugcagcugccucaagggcugcugcuccugcgggagcugcugcaaguucgacgaggacgacuccgagcccguccugaagggcgugaagcugcacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23885 - RNA, 4129 nt, Artificial Sequence
  SARS-CoV-2/Wuhan/WIV05/2019__EPI_ISL_402128 spike protein mRNA gc (1-1273)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23886 - RNA, 4129 nt, Artificial Sequence
  SARS-CoV-2/Wuhan/WIV05/2019__EPI_ISL_402128 spike protein mRNA gc (1-1273)(D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23887 - RNA, 4129 nt, Artificial Sequence
  SARS-CoV-2/Wuhan/WIV05/2019__EPI_ISL_402128 spike protein mRNA gc (1-1273)(A222V_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23888 - RNA, 4129 nt, Artificial Sequence
  SARS-CoV-2/Wuhan/WIV05/2019__EPI_ISL_402128 spike protein mRNA gc (1-1273)(N439K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23889 - RNA, 4129 nt, Artificial Sequence
  SARS-CoV-2/Wuhan/WIV05/2019__EPI_ISL_402128 spike protein mRNA gc (1-1273)(S477N_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23890 - RNA, 4129 nt, Artificial Sequence
  SARS-CoV-2/Wuhan/WIV05/2019__EPI_ISL_402128 spike protein mRNA gc (1-1273)(N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23891 - RNA, 4123 nt, Artificial Sequence
  SARS-CoV-2/Wuhan/WIV05/2019__EPI_ISL_402128 spike protein mRNA gc (1-1273)(H69del_V70del_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23892 - RNA, 4129 nt, Artificial Sequence
  SARS-CoV-2/Wuhan/WIV05/2019__EPI_ISL_402128 spike protein mRNA gc (1-1273)(Y453F_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23893 - RNA, 4129 nt, Artificial Sequence
  SARS-CoV-2/Wuhan/WIV05/2019__EPI_ISL_402128 spike protein mRNA gc (1-1273)(D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23894 - RNA, 4129 nt, Artificial Sequence
  SARS-CoV-2/Wuhan/WIV05/2019__EPI_ISL_402128 spike protein mRNA gc (1-1273)(D614G_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23895 - RNA, 4123 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23896 - RNA, 4123 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23897 - RNA, 4120 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23898 - RNA, 4129 nt, Artificial Sequence
  SARS-CoV-2/Wuhan/WIV05/2019__EPI_ISL_402128 spike protein mRNA gc (1-1273)(K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23899 - RNA, 4120 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23900 - RNA, 4129 nt, Artificial Sequence
  SARS-CoV-2/Wuhan/WIV05/2019__EPI_ISL_402128 spike protein mRNA gc (1-1273)(E484K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23901 - RNA, 4129 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23902 - RNA, 4129 nt, Artificial Sequence
  SARS-CoV-2/Wuhan/WIV05/2019__EPI_ISL_402128 spike protein mRNA gc (1-1273)(S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23903 - RNA, 4129 nt, Artificial Sequence
  SARS-CoV-2/Wuhan/WIV05/2019__EPI_ISL_402128 spike protein mRNA gc (1-1273)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23904 - RNA, 4129 nt, Artificial Sequence
  SARS-CoV-2/Wuhan/WIV05/2019__EPI_ISL_402128 spike protein mRNA gc (1-1273)(D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23905 - RNA, 4129 nt, Artificial Sequence
  SARS-CoV-2/Wuhan/WIV05/2019__EPI_ISL_402128 spike protein mRNA gc (1-1273)(A222V_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23906 - RNA, 4129 nt, Artificial Sequence
  SARS-CoV-2/Wuhan/WIV05/2019__EPI_ISL_402128 spike protein mRNA gc (1-1273)(N439K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23907 - RNA, 4129 nt, Artificial Sequence
  SARS-CoV-2/Wuhan/WIV05/2019__EPI_ISL_402128 spike protein mRNA gc (1-1273)(S477N_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23908 - RNA, 4129 nt, Artificial Sequence
  SARS-CoV-2/Wuhan/WIV05/2019__EPI_ISL_402128 spike protein mRNA gc (1-1273)(N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23909 - RNA, 4123 nt, Artificial Sequence
  SARS-CoV-2/Wuhan/WIV05/2019__EPI_ISL_402128 spike protein mRNA gc (1-1273)(H69del_V70del_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgugacauacguccccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23910 - RNA, 4129 nt, Artificial Sequence
  SARS-CoV-2/Wuhan/WIV05/2019__EPI_ISL_402128 spike protein mRNA gc (1-1273)(Y453F_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23911 - RNA, 4129 nt, Artificial Sequence
  SARS-CoV-2/Wuhan/WIV05/2019__EPI_ISL_402128 spike protein mRNA gc (1-1273)(D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23912 - RNA, 4129 nt, Artificial Sequence
  SARS-CoV-2/Wuhan/WIV05/2019__EPI_ISL_402128 spike protein mRNA gc (1-1273)(D614G_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23913 - RNA, 4123 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgccccacacggcguggucuuccuccacgugacauacgugcccgcccaggagaagaacuucaccaccgcccccgccaucugccacgacggcaaggcccacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23914 - RNA, 4123 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23915 - RNA, 4120 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacaagguggaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgucccagcccaggagaagaacuucacaaccgcccccgccaucugccacgacggcaaggcccacuucccccgggagggaguguucgugagcaacggcacccacugguucgugacccagcggaacuucuacgagccccagaucaucaccacccacaacaccuucgugagcggcaacugcgacguggugaucggcaucgugaacaacaccguguacgacccccugcagcccgagcuggacagcuucaaggaggagcuggacaaguacuucaagaaccacaccagcccugacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23916 - RNA, 4129 nt, Artificial Sequence
  SARS-CoV-2/Wuhan/WIV05/2019__EPI_ISL_402128 spike protein mRNA gc (1-1273)(K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23917 - RNA, 4120 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggacaagguggaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgccccacacggcguggucuuccugcacgugacauacgugcccgcccaggagaagaacuucaccaccgcccccgccaucugccacgacggaaaggcccacuucccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcucgacaaguacuucaagaaccacaccagccccgacguggaccugggcgacaucagcggcaucaacgcuagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23918 - RNA, 4129 nt, Artificial Sequence
  SARS-CoV-2/Wuhan/WIV05/2019__EPI_ISL_402128 spike protein mRNA gc (1-1273)(E484K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23919 - RNA, 4129 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacaagguggaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgucaccuacgugccagcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccugacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23920 - RNA, 4129 nt, Artificial Sequence
  SARS-CoV-2/Wuhan/WIV05/2019__EPI_ISL_402128 spike protein mRNA gc (1-1273)(S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggacaagguggaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgccccacacggcgugguguuccugcacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagccagugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23921 - RNA, 4129 nt, Artificial Sequence
  SARS-CoV-2/Wuhan/WIV05/2019__EPI_ISL_402128 spike protein mRNA gc mod (1-1273)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23922 - RNA, 4129 nt, Artificial Sequence
  SARS-CoV-2/Wuhan/WIV05/2019__EPI_ISL_402128 spike protein mRNA gc mod (1-1273)(D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23923 - RNA, 4129 nt, Artificial Sequence
  SARS-CoV-2/Wuhan/WIV05/2019__EPI_ISL_402128 spike protein mRNA gc mod (1-1273)(A222V_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23924 - RNA, 4129 nt, Artificial Sequence
  SARS-CoV-2/Wuhan/WIV05/2019__EPI_ISL_402128 spike protein mRNA gc mod (1-1273)(N439K_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23925 - RNA, 4129 nt, Artificial Sequence
  SARS-CoV-2/Wuhan/WIV05/2019__EPI_ISL_402128 spike protein mRNA gc mod (1-1273)(S477N_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23926 - RNA, 4129 nt, Artificial Sequence
  SARS-CoV-2/Wuhan/WIV05/2019__EPI_ISL_402128 spike protein mRNA gc mod (1-1273)(N501Y_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23927 - RNA, 4123 nt, Artificial Sequence
  SARS-CoV-2/Wuhan/WIV05/2019__EPI_ISL_402128 spike protein mRNA gc mod (1-1273)(H69del_V70del_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23928 - RNA, 4129 nt, Artificial Sequence
  SARS-CoV-2/Wuhan/WIV05/2019__EPI_ISL_402128 spike protein mRNA gc mod (1-1273)(Y453F_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23929 - RNA, 4129 nt, Artificial Sequence
  SARS-CoV-2/Wuhan/WIV05/2019__EPI_ISL_402128 spike protein mRNA gc mod (1-1273)(D614G_I692V)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23930 - RNA, 4129 nt, Artificial Sequence
  SARS-CoV-2/Wuhan/WIV05/2019__EPI_ISL_402128 spike protein mRNA gc mod (1-1273)(D614G_M1229I)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23931 - RNA, 4123 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23932 - RNA, 4123 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23933 - RNA, 4120 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23934 - RNA, 4129 nt, Artificial Sequence
  SARS-CoV-2/Wuhan/WIV05/2019__EPI_ISL_402128 spike protein mRNA gc mod (1-1273)(K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23935 - RNA, 4120 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23936 - RNA, 4129 nt, Artificial Sequence
  SARS-CoV-2/Wuhan/WIV05/2019__EPI_ISL_402128 spike protein mRNA gc mod (1-1273)(E484K_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23937 - RNA, 4129 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23938 - RNA, 4129 nt, Artificial Sequence
  SARS-CoV-2/Wuhan/WIV05/2019__EPI_ISL_402128 spike protein mRNA gc mod (1-1273)(S13I_W152C_L452R_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23939 - RNA, 4129 nt, Artificial Sequence
  SARS-CoV-2/Wuhan/WIV05/2019__EPI_ISL_402128 spike protein mRNA gc mod (1-1273)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23940 - RNA, 4129 nt, Artificial Sequence
  SARS-CoV-2/Wuhan/WIV05/2019__EPI_ISL_402128 spike protein mRNA gc mod (1-1273)(D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23941 - RNA, 4129 nt, Artificial Sequence
  SARS-CoV-2/Wuhan/WIV05/2019__EPI_ISL_402128 spike protein mRNA gc mod (1-1273)(A222V_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23942 - RNA, 4129 nt, Artificial Sequence
  SARS-CoV-2/Wuhan/WIV05/2019__EPI_ISL_402128 spike protein mRNA gc mod (1-1273)(N439K_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
